United States Patent 7,618,814 (MICRORNA-RELATED NUCLEIC ACIDS AND USES THEREOF) - sequence listing, part 14

SEQ ID NO: 523568 - RNA, 32 nt, Human
uggcucacaccuguaaucccagcacuucggga

SEQ ID NO: 523569 - RNA, 32 nt, Human
uggcucacaccuguaaucccagcacuugggaa

SEQ ID NO: 523570 - RNA, 32 nt, Human
uggcucacaccuguaaucccagcacuugggga

SEQ ID NO: 523571 - RNA, 32 nt, Human
uggcucacaccuguaaucccagcacuuugaga

SEQ ID NO: 523572 - RNA, 32 nt, Human
uggcucacaccuguaaucccagcacuuugcgg

SEQ ID NO: 523573 - RNA, 32 nt, Human
uggcucacaccuguaaucccagcacuuuggca

SEQ ID NO: 523574 - RNA, 32 nt, Human
uggcucacaccuguaaucccagcacuuuggga

SEQ ID NO: 523575 - RNA, 32 nt, Human
uggcucacaccuguaaucccagcacuuugggg

SEQ ID NO: 523576 - RNA, 32 nt, Human
uggcucacaccuguaaucccagcacuuuggua

SEQ ID NO: 523577 - RNA, 32 nt, Human
uggcucacaccuguaaucccagcacuuuugga

SEQ ID NO: 523578 - RNA, 32 nt, Human
uggcucacaccuguaaucccagcgcuuuggga

SEQ ID NO: 523579 - RNA, 24 nt, Human
uggcucacaccuguaaucccagcu

SEQ ID NO: 523580 - RNA, 23 nt, Human
uggcucacaccuguaaucccagu

SEQ ID NO: 523581 - RNA, 24 nt, Human
uggcucacaccuguaauccccagc

SEQ ID NO: 523582 - RNA, 32 nt, Human
uggcucacaccuguaauccccagcacuuuggg

SEQ ID NO: 523583 - RNA, 22 nt, Human
uggcucacaccuguaaucccgc

SEQ ID NO: 523584 - RNA, 23 nt, Human
uggcucacaccuguaaucccggc

SEQ ID NO: 523585 - RNA, 23 nt, Human
uggcucacaccuguaaucccugc

SEQ ID NO: 523586 - RNA, 21 nt, Human
uggcucacaccuguaauccua

SEQ ID NO: 523587 - RNA, 23 nt, Human
uggcucacaccuguaauccuagc

SEQ ID NO: 523588 - RNA, 21 nt, Human
uggcucacaccuguaaucuca

SEQ ID NO: 523589 - RNA, 23 nt, Human
uggcucacaccuguaaucucagc

SEQ ID NO: 523590 - RNA, 23 nt, Human
uggcucacaccuguaaucugagc

SEQ ID NO: 523591 - RNA, 21 nt, Human
uggcucacaccuguaaucuua

SEQ ID NO: 523592 - RNA, 21 nt, Human
uggcucacaccuguaaugcca

SEQ ID NO: 523593 - RNA, 23 nt, Human
uggcucacaccuguaaugccagc

SEQ ID NO: 523594 - RNA, 32 nt, Human
uggcucacaccuguaaugccagcacuuugggc

SEQ ID NO: 523595 - RNA, 18 nt, Human
uggcucacaccuguaauu

SEQ ID NO: 523596 - RNA, 21 nt, Human
uggcucacaccuguaauucca

SEQ ID NO: 523597 - RNA, 32 nt, Human
uggcucacaccuguaauuccaacacuuuggga

SEQ ID NO: 523598 - RNA, 23 nt, Human
uggcucacaccuguaauuccagc

SEQ ID NO: 523599 - RNA, 32 nt, Human
uggcucacaccuguaauuccagcacuugggga

SEQ ID NO: 523600 - RNA, 32 nt, Human
uggcucacaccuguaauuccagcacuuuggga

SEQ ID NO: 523601 - RNA, 32 nt, Human
uggcucacaccuguaauuccagcacuuuguga

SEQ ID NO: 523602 - RNA, 32 nt, Human
uggcucacaccuguaauucuagcacuuuggga

SEQ ID NO: 523603 - RNA, 23 nt, Human
uggcucacaccuguaauugcagc

SEQ ID NO: 523604 - RNA, 23 nt, Human
uggcucacaccuguaauuucagc

SEQ ID NO: 523605 - RNA, 21 nt, Human
uggcucacaccuguaguccca

SEQ ID NO: 523606 - RNA, 23 nt, Human
uggcucacaccuguagucccagc

SEQ ID NO: 523607 - RNA, 32 nt, Human
uggcucacaccuguagucccagcacuuuagga

SEQ ID NO: 523608 - RNA, 24 nt, Human
uggcucacaccuguagucccagcu

SEQ ID NO: 523609 - RNA, 32 nt, Human
uggcucacaccuguaucccagcacuuugggag

SEQ ID NO: 523610 - RNA, 32 nt, Human
uggcucacaccugucauuccagcacuuugaga

SEQ ID NO: 523611 - RNA, 23 nt, Human
uggcucacaccugucauuccggc

SEQ ID NO: 523612 - RNA, 21 nt, Human
uggcucacaccugugauccca

SEQ ID NO: 523613 - RNA, 23 nt, Human
uggcucacaccugugaucccagc

SEQ ID NO: 523614 - RNA, 32 nt, Human
uggcucacaccugugaucccagcacuugggaa

SEQ ID NO: 523615 - RNA, 32 nt, Human
uggcucacaccugugaucccagcacuugggga

SEQ ID NO: 523616 - RNA, 32 nt, Human
uggcucacaccugugaucccagcacuuuggga

SEQ ID NO: 523617 - RNA, 32 nt, Human
uggcucacaccuguggucccagcucuuuggaa

SEQ ID NO: 523618 - RNA, 22 nt, Human
uggcucacaccuguuaauccca

SEQ ID NO: 523619 - RNA, 21 nt, Human
uggcucacaccuguuauccca

SEQ ID NO: 523620 - RNA, 20 nt, Human
uggcucacaccuuaauccca

SEQ ID NO: 523621 - RNA, 32 nt, Human
uggcucacaccuuaaucccagcacuuugggag

SEQ ID NO: 523622 - RNA, 22 nt, Human
uggcucacaccuuguaauccca

SEQ ID NO: 523623 - RNA, 24 nt, Human
uggcucacaccuuguaaucccagc

SEQ ID NO: 523624 - RNA, 21 nt, Human
uggcucacaccuuuaauccca

SEQ ID NO: 523625 - RNA, 21 nt, Human
uggcucacacguauaauccua

SEQ ID NO: 523626 - RNA, 21 nt, Human
uggcucacacguguaauccca

SEQ ID NO: 523627 - RNA, 32 nt, Human
uggcucacacuguaaucccagcacuuugggag

SEQ ID NO: 523628 - RNA, 32 nt, Human
uggcucacacuguaaugccagcacuuugggag

SEQ ID NO: 523629 - RNA, 21 nt, Human
uggcucacacuuauaauccca

SEQ ID NO: 523630 - RNA, 21 nt, Human
uggcucacacuuauaauccua

SEQ ID NO: 523631 - RNA, 21 nt, Human
uggcucacacuuguaauccca

SEQ ID NO: 523632 - RNA, 23 nt, Human
uggcucacacuuguaaucccagc

SEQ ID NO: 523633 - RNA, 32 nt, Human
uggcucacagaaaccuccgccucccagguuca

SEQ ID NO: 523634 - RNA, 32 nt, Human
uggcucacagcaaccucuaccuccuggguuca

SEQ ID NO: 523635 - RNA, 32 nt, Human
uggcucacagcagccucugccucccggguuca

SEQ ID NO: 523636 - RNA, 21 nt, Human
uggcucacagcuauaaucuca

SEQ ID NO: 523637 - RNA, 32 nt, Human
uggcucacaggaaccuccgccucccagguuca

SEQ ID NO: 523638 - RNA, 32 nt, Human
uggcucacaguguaaucccaacacuuugagaa

SEQ ID NO: 523639 - RNA, 21 nt, Human
uggcucacaucuguaauacca

SEQ ID NO: 523640 - RNA, 24 nt, Human
uggcucacaucuguaauaccagcu

SEQ ID NO: 523641 - RNA, 21 nt, Human
uggcucacaucuguaauccca

SEQ ID NO: 523642 - RNA, 23 nt, Human
uggcucacaucuguaaucccagc

SEQ ID NO: 523643 - RNA, 21 nt, Human
uggcucacaucuguaaucuca

SEQ ID NO: 523644 - RNA, 21 nt, Human
uggcucacaucuguaaugcca

SEQ ID NO: 523645 - RNA, 21 nt, Human
uggcucacauguguaauccca

SEQ ID NO: 523646 - RNA, 21 nt, Human
uggcucacauucguaauccca

SEQ ID NO: 523647 - RNA, 32 nt, Human
uggcucaccacaaccuccaccucccagguuca

SEQ ID NO: 523648 - RNA, 32 nt, Human
uggcucaccacaaccuccgccucccggauuca

SEQ ID NO: 523649 - RNA, 32 nt, Human
uggcucaccacaaccucuaccuccaggguuca

SEQ ID NO: 523650 - RNA, 32 nt, Human
uggcucaccacaaccucugccucccggguuca

SEQ ID NO: 523651 - RNA, 32 nt, Human
uggcucaccacaaccucugccuccuggguuca

SEQ ID NO: 523652 - RNA, 32 nt, Human
uggcucaccaccaauucguucucucugcccca

SEQ ID NO: 523653 - RNA, 32 nt, Human
uggcucaccagcuguucagaugcuuccaguau

SEQ ID NO: 523654 - RNA, 32 nt, Human
uggcucaccauaaccuccgccucccagguuca

SEQ ID NO: 523655 - RNA, 22 nt, Human
uggcucacccccuguaauccca

SEQ ID NO: 523656 - RNA, 24 nt, Human
uggcucacccccuguaaucccagc

SEQ ID NO: 523657 - RNA, 21 nt, Human
uggcucaccccuguaauccca

SEQ ID NO: 523658 - RNA, 23 nt, Human
uggcucaccccuguaaucccagc

SEQ ID NO: 523659 - RNA, 23 nt, Human
uggcucaccccuguaaucccagu

SEQ ID NO: 523660 - RNA, 21 nt, Human
uggcucaccccuguaauccua

SEQ ID NO: 523661 - RNA, 21 nt, Human
uggcucaccccuguaaucuca

SEQ ID NO: 523662 - RNA, 21 nt, Human
uggcucaccccuguaauucca

SEQ ID NO: 523663 - RNA, 23 nt, Human
uggcucaccccuguaauuccagc

SEQ ID NO: 523664 - RNA, 22 nt, Human
uggcucaccgaaagcucacaga

SEQ ID NO: 523665 - RNA, 32 nt, Human
uggcucaccgcaaccuccgccucccagguuca

SEQ ID NO: 523666 - RNA, 32 nt, Human
uggcucaccgcaaccuccgccucccggguuca

SEQ ID NO: 523667 - RNA, 32 nt, Human
uggcucaccgcaaccuccgccuccuaggucca

SEQ ID NO: 523668 - RNA, 32 nt, Human
uggcucaccgcaaccucugccuaccggguuca

SEQ ID NO: 523669 - RNA, 32 nt, Human
uggcucaccgcaaccucugccucccugguuca

SEQ ID NO: 523670 - RNA, 32 nt, Human
uggcucaccgcaaccucugccuccuggguuca

SEQ ID NO: 523671 - RNA, 32 nt, Human
uggcucaccgcagccuccaccuccaggguuca

SEQ ID NO: 523672 - RNA, 32 nt, Human
uggcucaccguaaucuccgccucccaggcuca

SEQ ID NO: 523673 - RNA, 32 nt, Human
uggcucaccucaaccucugccucccagguuca

SEQ ID NO: 523674 - RNA, 21 nt, Human
uggcucaccucuguaauccca

SEQ ID NO: 523675 - RNA, 23 nt, Human
uggcucaccucuguaaucccagc

SEQ ID NO: 523676 - RNA, 32 nt, Human
uggcucaccuguaaucccaacacuuugggagg

SEQ ID NO: 523677 - RNA, 32 nt, Human
uggcucaccuguaaucccagcacuuugggagg

SEQ ID NO: 523678 - RNA, 32 nt, Human
uggcucacgacaaccucugccucucggauuca

SEQ ID NO: 523679 - RNA, 21 nt, Human
uggcucacgacuguaauucca

SEQ ID NO: 523680 - RNA, 23 nt, Human
uggcucacgacuguaauuccagc

SEQ ID NO: 523681 - RNA, 21 nt, Human
uggcucacgcauguaauccca

SEQ ID NO: 523682 - RNA, 32 nt, Human
uggcucacgcauguaaucccagcacuuuggga

SEQ ID NO: 523683 - RNA, 21 nt, Human
uggcucacgcauguaauccua

SEQ ID NO: 523684 - RNA, 21 nt, Human
uggcucacgccacuaauccca

SEQ ID NO: 523685 - RNA, 21 nt, Human
uggcucacgccaguaauccca

SEQ ID NO: 523686 - RNA, 32 nt, Human
uggcucacgccaguaaucccagcacuuuggag

SEQ ID NO: 523687 - RNA, 32 nt, Human
uggcucacgccaguaaucccagcacuuuggga

SEQ ID NO: 523688 - RNA, 32 nt, Human
uggcucacgcccauaauccagcacuuugggaa

SEQ ID NO: 523689 - RNA, 21 nt, Human
uggcucacgcccguaauccca

SEQ ID NO: 523690 - RNA, 21 nt, Human
uggcucacgccgguaauccca

SEQ ID NO: 523691 - RNA, 32 nt, Human
uggcucacgccgguaaucccagcacuuuggga

SEQ ID NO: 523692 - RNA, 21 nt, Human
uggcucacgccuauaauccca

SEQ ID NO: 523693 - RNA, 32 nt, Human
uggcucacgccuauaaucccagcacuuaggga

SEQ ID NO: 523694 - RNA, 32 nt, Human
uggcucacgccuauaaucccagcacuuccaga

SEQ ID NO: 523695 - RNA, 32 nt, Human
uggcucacgccuauaaucccagcacuuuagga

SEQ ID NO: 523696 - RNA, 32 nt, Human
uggcucacgccuauaaucccagcacuuugcga

SEQ ID NO: 523697 - RNA, 32 nt, Human
uggcucacgccuauaaucccagcacuuuggga

SEQ ID NO: 523698 - RNA, 21 nt, Human
uggcucacgccuauaauccua

SEQ ID NO: 523699 - RNA, 21 nt, Human
uggcucacgccuauaaucuca

SEQ ID NO: 523700 - RNA, 21 nt, Human
uggcucacgccuauaauucca

SEQ ID NO: 523701 - RNA, 23 nt, Human
uggcucacgccuauaauuccagc

SEQ ID NO: 523702 - RNA, 32 nt, Human
uggcucacgccuauaucccagcacuuugggag

SEQ ID NO: 523703 - RNA, 21 nt, Human
uggcucacgccuaugauccca

SEQ ID NO: 523704 - RNA, 21 nt, Human
uggcucacgccucuaauccca

SEQ ID NO: 523705 - RNA, 32 nt, Human
uggcucacgccucuaaucccagcacuuuggga

SEQ ID NO: 523706 - RNA, 32 nt, Human
uggcucacgccugaaaucccagcacuuuggga

SEQ ID NO: 523707 - RNA, 32 nt, Human
uggcucacgccugcaaucccagcacuuuggga

SEQ ID NO: 523708 - RNA, 32 nt, Human
uggcucacgccugcaaugccagcacuuugaga

SEQ ID NO: 523709 - RNA, 32 nt, Human
uggcucacgccugcagucccagcacuuuggga

SEQ ID NO: 523710 - RNA, 32 nt, Human
uggcucacgccuggaaucccagcacuugaggc

SEQ ID NO: 523711 - RNA, 32 nt, Human
uggcucacgccuggaaucccagcacuuuggga

SEQ ID NO: 523712 - RNA, 21 nt, Human
uggcucacgccuguaaaccca

SEQ ID NO: 523713 - RNA, 23 nt, Human
uggcucacgccuguaaacccagc

SEQ ID NO: 523714 - RNA, 32 nt, Human
uggcucacgccuguaaacccagcacuuuagga

SEQ ID NO: 523715 - RNA, 21 nt, Human
uggcucacgccuguaacccca

SEQ ID NO: 523716 - RNA, 23 nt, Human
uggcucacgccuguaaccccagc

SEQ ID NO: 523717 - RNA, 32 nt, Human
uggcucacgccuguaaccccagcacuuuggga

SEQ ID NO: 523718 - RNA, 32 nt, Human
uggcucacgccuguaacccuagcacuuuggga

SEQ ID NO: 523719 - RNA, 21 nt, Human
uggcucacgccuguaaccuca

SEQ ID NO: 523720 - RNA, 23 nt, Human
uggcucacgccuguaaccucagc

SEQ ID NO: 523721 - RNA, 32 nt, Human
uggcucacgccuguaaccucagcacuuuggga

SEQ ID NO: 523722 - RNA, 21 nt, Human
uggcucacgccuguaauacca

SEQ ID NO: 523723 - RNA, 18 nt, Human
uggcucacgccuguaauc

SEQ ID NO: 523724 - RNA, 32 nt, Human
uggcucacgccuguaaucacacuuucggaggc

SEQ ID NO: 523725 - RNA, 23 nt, Human
uggcucacgccuguaaucacagc

SEQ ID NO: 523726 - RNA, 32 nt, Human
uggcucacgccuguaaucacagcacuuuggga

SEQ ID NO: 523727 - RNA, 19 nt, Human
uggcucacgccuguaaucc

SEQ ID NO: 523728 - RNA, 20 nt, Human
uggcucacgccuguaaucca

SEQ ID NO: 523729 - RNA, 32 nt, Human
uggcucacgccuguaauccaacacuuugagag

SEQ ID NO: 523730 - RNA, 23 nt, Human
uggcucacgccuguaauccaagc

SEQ ID NO: 523731 - RNA, 32 nt, Human
uggcucacgccuguaauccaagcacuugggga

SEQ ID NO: 523732 - RNA, 22 nt, Human
uggcucacgccuguaauccagc

SEQ ID NO: 523733 - RNA, 32 nt, Human
uggcucacgccuguaauccagcacuuugggag

SEQ ID NO: 523734 - RNA, 20 nt, Human
uggcucacgccuguaauccc

SEQ ID NO: 523735 - RNA, 21 nt, Human
uggcucacgccuguaauccca

SEQ ID NO: 523736 - RNA, 32 nt, Human
uggcucacgccuguaaucccaacacuuuagga

SEQ ID NO: 523737 - RNA, 32 nt, Human
uggcucacgccuguaaucccaacacuuuggga

SEQ ID NO: 523738 - RNA, 32 nt, Human
uggcucacgccuguaaucccaacacuuuucga

SEQ ID NO: 523739 - RNA, 32 nt, Human
uggcucacgccuguaaucccaccacuuuggaa

SEQ ID NO: 523740 - RNA, 32 nt, Human
uggcucacgccuguaaucccaccacuuuggga

SEQ ID NO: 523741 - RNA, 22 nt, Human
uggcucacgccuguaaucccag

SEQ ID NO: 523742 - RNA, 32 nt, Human
uggcucacgccuguaaucccagaacuuugaga

SEQ ID NO: 523743 - RNA, 32 nt, Human
uggcucacgccuguaaucccagaacuuuggga

SEQ ID NO: 523744 - RNA, 32 nt, Human
uggcucacgccuguaaucccagacuuugggag

SEQ ID NO: 523745 - RNA, 23 nt, Human
uggcucacgccuguaaucccagc

SEQ ID NO: 523746 - RNA, 32 nt, Human
uggcucacgccuguaaucccagcacuuagggu

SEQ ID NO: 523747 - RNA, 32 nt, Human
uggcucacgccuguaaucccagcacuucggga

SEQ ID NO: 523748 - RNA, 32 nt, Human
uggcucacgccuguaaucccagcacuucgggg

SEQ ID NO: 523749 - RNA, 32 nt, Human
uggcucacgccuguaaucccagcacuugggag

SEQ ID NO: 523750 - RNA, 32 nt, Human
uggcucacgccuguaaucccagcacuugggga

SEQ ID NO: 523751 - RNA, 32 nt, Human
uggcucacgccuguaaucccagcacuuuaaga

SEQ ID NO: 523752 - RNA, 32 nt, Human
uggcucacgccuguaaucccagcacuuuagga

SEQ ID NO: 523753 - RNA, 32 nt, Human
uggcucacgccuguaaucccagcacuuugaga

SEQ ID NO: 523754 - RNA, 32 nt, Human
uggcucacgccuguaaucccagcacuuugcga

SEQ ID NO: 523755 - RNA, 32 nt, Human
uggcucacgccuguaaucccagcacuuugcgg

SEQ ID NO: 523756 - RNA, 32 nt, Human
uggcucacgccuguaaucccagcacuuuggaa

SEQ ID NO: 523757 - RNA, 32 nt, Human
uggcucacgccuguaaucccagcacuuuggag

SEQ ID NO: 523758 - RNA, 32 nt, Human
uggcucacgccuguaaucccagcacuuuggca

SEQ ID NO: 523759 - RNA, 32 nt, Human
uggcucacgccuguaaucccagcacuuuggga

SEQ ID NO: 523760 - RNA, 32 nt, Human
uggcucacgccuguaaucccagcacuuugggg

SEQ ID NO: 523761 - RNA, 32 nt, Human
uggcucacgccuguaaucccagcacuuuggua

SEQ ID NO: 523762 - RNA, 32 nt, Human
uggcucacgccuguaaucccagcacuuugguu

SEQ ID NO: 523763 - RNA, 32 nt, Human
uggcucacgccuguaaucccagcacuuugugg

SEQ ID NO: 523764 - RNA, 32 nt, Human
uggcucacgccuguaaucccagcacuuuugga

SEQ ID NO: 523765 - RNA, 32 nt, Human
uggcucacgccuguaaucccagcacuuuuggg

SEQ ID NO: 523766 - RNA, 32 nt, Human
uggcucacgccuguaaucccagcaguuuggga

SEQ ID NO: 523767 - RNA, 32 nt, Human
uggcucacgccuguaaucccagcauuugggag

SEQ ID NO: 523768 - RNA, 32 nt, Human
uggcucacgccuguaaucccagcauuuuggga

SEQ ID NO: 523769 - RNA, 32 nt, Human
uggcucacgccuguaaucccagcgcuuuggga

SEQ ID NO: 523770 - RNA, 24 nt, Human
uggcucacgccuguaaucccagcu

SEQ ID NO: 523771 - RNA, 32 nt, Human
uggcucacgccuguaaucccagcucuuuggga

SEQ ID NO: 523772 - RNA, 32 nt, Human
uggcucacgccuguaaucccagcucuuugugg

SEQ ID NO: 523773 - RNA, 32 nt, Human
uggcucacgccuguaaucccaggacuuuagga

SEQ ID NO: 523774 - RNA, 32 nt, Human
uggcucacgccuguaaucccaggacuuuggga

SEQ ID NO: 523775 - RNA, 23 nt, Human
uggcucacgccuguaaucccagu

SEQ ID NO: 523776 - RNA, 32 nt, Human
uggcucacgccuguaaucccaguacuugggag

SEQ ID NO: 523777 - RNA, 32 nt, Human
uggcucacgccuguaaucccaguacuuuggga

SEQ ID NO: 523778 - RNA, 32 nt, Human
uggcucacgccuguaaucccaguauuuuggga

SEQ ID NO: 523779 - RNA, 32 nt, Human
uggcucacgccuguaauccccgcacuuuggga

SEQ ID NO: 523780 - RNA, 23 nt, Human
uggcucacgccuguaaucccggc

SEQ ID NO: 523781 - RNA, 32 nt, Human
uggcucacgccuguaaucccggcacuuuggga

SEQ ID NO: 523782 - RNA, 32 nt, Human
uggcucacgccuguaaucccgguauuuuggga

SEQ ID NO: 523783 - RNA, 23 nt, Human
uggcucacgccuguaaucccugc

SEQ ID NO: 523784 - RNA, 23 nt, Human
uggcucacgccuguaauccgagc

SEQ ID NO: 523785 - RNA, 21 nt, Human
uggcucacgccuguaauccua

SEQ ID NO: 523786 - RNA, 23 nt, Human
uggcucacgccuguaauccuagc

SEQ ID NO: 523787 - RNA, 32 nt, Human
uggcucacgccuguaauccuagcacuugggag

SEQ ID NO: 523788 - RNA, 32 nt, Human
uggcucacgccuguaauccuagcacuuuggaa

SEQ ID NO: 523789 - RNA, 32 nt, Human
uggcucacgccuguaauccuagcacuuuggga

SEQ ID NO: 523790 - RNA, 32 nt, Human
uggcucacgccuguaauccuagcacuuuguaa

SEQ ID NO: 523791 - RNA, 32 nt, Human
uggcucacgccuguaauccuagcauuuuggga

SEQ ID NO: 523792 - RNA, 32 nt, Human
uggcucacgccuguaauccuagcauuuugggu

SEQ ID NO: 523793 - RNA, 32 nt, Human
uggcucacgccuguaauccuagcauuuuugga

SEQ ID NO: 523794 - RNA, 23 nt, Human
uggcucacgccuguaauccuggc

SEQ ID NO: 523795 - RNA, 21 nt, Human
uggcucacgccuguaaucgca

SEQ ID NO: 523796 - RNA, 23 nt, Human
uggcucacgccuguaaucgcagc

SEQ ID NO: 523797 - RNA, 32 nt, Human
uggcucacgccuguaaucgcagcacuuuggga

SEQ ID NO: 523798 - RNA, 23 nt, Human
uggcucacgccuguaaucgcggc

SEQ ID NO: 523799 - RNA, 32 nt, Human
uggcucacgccuguaaucgcggcacuuuggga

SEQ ID NO: 523800 - RNA, 21 nt, Human
uggcucacgccuguaaucuca

SEQ ID NO: 523801 - RNA, 23 nt, Human
uggcucacgccuguaaucucagc

SEQ ID NO: 523802 - RNA, 32 nt, Human
uggcucacgccuguaaucucagcacuuuaaga

SEQ ID NO: 523803 - RNA, 32 nt, Human
uggcucacgccuguaaucucagcacuuuggga

SEQ ID NO: 523804 - RNA, 32 nt, Human
uggcucacgccuguaaucucagcacuuugggu

SEQ ID NO: 523805 - RNA, 32 nt, Human
uggcucacgccuguaaucucagcauuuuggga

SEQ ID NO: 523806 - RNA, 32 nt, Human
uggcucacgccuguaaucucggcacuuuggga

SEQ ID NO: 523807 - RNA, 32 nt, Human
uggcucacgccuguaaugccagcacuuuggga

SEQ ID NO: 523808 - RNA, 21 nt, Human
uggcucacgccuguaauucca

SEQ ID NO: 523809 - RNA, 23 nt, Human
uggcucacgccuguaauuccagc

SEQ ID NO: 523810 - RNA, 32 nt, Human
uggcucacgccuguaauuccagcacuucgaga

SEQ ID NO: 523811 - RNA, 32 nt, Human
uggcucacgccuguaauuccagcacuuuggga

SEQ ID NO: 523812 - RNA, 32 nt, Human
uggcucacgccuguaauuccagugcuuuggga

SEQ ID NO: 523813 - RNA, 32 nt, Human
uggcucacgccuguaauuccaucauuuuggga

SEQ ID NO: 523814 - RNA, 23 nt, Human
uggcucacgccuguaauucuagc

SEQ ID NO: 523815 - RNA, 32 nt, Human
uggcucacgccuguaauucuagcacuuuggga

SEQ ID NO: 523816 - RNA, 21 nt, Human
uggcucacgccuguaguccca

SEQ ID NO: 523817 - RNA, 22 nt, Human
uggcucacgccuguagucccag

SEQ ID NO: 523818 - RNA, 23 nt, Human
uggcucacgccuguagucccagc

SEQ ID NO: 523819 - RNA, 32 nt, Human
uggcucacgccuguagucccagcacuuugaga

SEQ ID NO: 523820 - RNA, 32 nt, Human
uggcucacgccuguagucccagcacuuuggga

SEQ ID NO: 523821 - RNA, 24 nt, Human
uggcucacgccuguagucccagcu

SEQ ID NO: 523822 - RNA, 32 nt, Human
uggcucacgccuguaucccagcacuuugggag

SEQ ID NO: 523823 - RNA, 32 nt, Human
uggcucacgccuguaucccagcuugugcuuug

SEQ ID NO: 523824 - RNA, 32 nt, Human
uggcucacgccuguaugccagcauuuugggag

SEQ ID NO: 523825 - RNA, 32 nt, Human
uggcucacgccuguauuccagcacuuugggag

SEQ ID NO: 523826 - RNA, 32 nt, Human
uggcucacgccugucaucccagcacuuuggga

SEQ ID NO: 523827 - RNA, 32 nt, Human
uggcucacgccugugauaccagcacuuuuggg

SEQ ID NO: 523828 - RNA, 21 nt, Human
uggcucacgccugugauccca

SEQ ID NO: 523829 - RNA, 23 nt, Human
uggcucacgccugugaucccagc

SEQ ID NO: 523830 - RNA, 32 nt, Human
uggcucacgccugugaucccagcacuuuggga

SEQ ID NO: 523831 - RNA, 32 nt, Human
uggcucacgccugugaucucagcacuuugagg

SEQ ID NO: 523832 - RNA, 23 nt, Human
uggcucacgccuguggucccagc

SEQ ID NO: 523833 - RNA, 32 nt, Human
uggcucacgccuguggucccagcacuuuggca

SEQ ID NO: 523834 - RNA, 32 nt, Human
uggcucacgccuguggucccagcacuuuggga

SEQ ID NO: 523835 - RNA, 32 nt, Human
uggcucacgccuguggucccagcacuuugggg

SEQ ID NO: 523836 - RNA, 32 nt, Human
uggcucacgccuguggucucagcacuuuggga

SEQ ID NO: 523837 - RNA, 32 nt, Human
uggcucacgccuguuaucccagcacuuuggga

SEQ ID NO: 523838 - RNA, 21 nt, Human
uggcucacgcuuauaauccca

SEQ ID NO: 523839 - RNA, 23 nt, Human
uggcucacgcuuauguaguccca

SEQ ID NO: 523840 - RNA, 21 nt, Human
uggcucacgcuuguaauccca

SEQ ID NO: 523841 - RNA, 23 nt, Human
uggcucacgcuuguaaucccagc

SEQ ID NO: 523842 - RNA, 32 nt, Human
uggcucacgcuuguaaucccagcacuuuggga

SEQ ID NO: 523843 - RNA, 24 nt, Human
uggcucacgcuuguaaucccagcu

SEQ ID NO: 523844 - RNA, 21 nt, Human
uggcucacgcuuguaaucgca

SEQ ID NO: 523845 - RNA, 32 nt, Human
uggcucacgcuuguaaucgcagcacuuuggga

SEQ ID NO: 523846 - RNA, 32 nt, Human
uggcucacgcuuguaaucucagcacuuuggga

SEQ ID NO: 523847 - RNA, 21 nt, Human
uggcucacgcuuguaauucca

SEQ ID NO: 523848 - RNA, 23 nt, Human
uggcucacgcuuguaauuccagc

SEQ ID NO: 523849 - RNA, 32 nt, Human
uggcucacgcuuguaauuccagcacuuuggga

SEQ ID NO: 523850 - RNA, 32 nt, Human
uggcucacggcaacuucagccuucccagguuc

SEQ ID NO: 523851 - RNA, 21 nt, Human
uggcucacguauguaauccca

SEQ ID NO: 523852 - RNA, 21 nt, Human
uggcucacgucuauaauccca

SEQ ID NO: 523853 - RNA, 21 nt, Human
uggcucacgucuguaauccca

SEQ ID NO: 523854 - RNA, 23 nt, Human
uggcucacgucuguaaucccagc

SEQ ID NO: 523855 - RNA, 32 nt, Human
uggcucacgucuguaaucccagcacuuuggaa

SEQ ID NO: 523856 - RNA, 32 nt, Human
uggcucacgucuguaaucccagcacuuuggga

SEQ ID NO: 523857 - RNA, 32 nt, Human
uggcucacgucuguaaucucagcacuuaggga

SEQ ID NO: 523858 - RNA, 32 nt, Human
uggcucacgucuguaaugccagcacuucggga

SEQ ID NO: 523859 - RNA, 21 nt, Human
uggcucacguuuguaauccca

SEQ ID NO: 523860 - RNA, 23 nt, Human
uggcucacguuuguaaucccagc

SEQ ID NO: 523861 - RNA, 32 nt, Human
uggcucacguuuguaaucccagcacuuuggga

SEQ ID NO: 523862 - RNA, 32 nt, Human
uggcucacuacaaccuccaccucccagguuca

SEQ ID NO: 523863 - RNA, 32 nt, Human
uggcucacuacaaccuccaccucccggguuca

SEQ ID NO: 523864 - RNA, 32 nt, Human
uggcucacuacaaccuccaccuuccaggcuua

SEQ ID NO: 523865 - RNA, 32 nt, Human
uggcucacuacaaccuccgccucccagguuca

SEQ ID NO: 523866 - RNA, 32 nt, Human
uggcucacuacaaccuccgccuccuggguuca

SEQ ID NO: 523867 - RNA, 32 nt, Human
uggcucacuacaaccucugccucccggguuca

SEQ ID NO: 523868 - RNA, 32 nt, Human
uggcucacuacaaccucugccucgcagguuca

SEQ ID NO: 523869 - RNA, 23 nt, Human
uggcucacuacucuaauuccagc

SEQ ID NO: 523870 - RNA, 32 nt, Human
uggcucacuacuguaauuccagcacuuuggga

SEQ ID NO: 523871 - RNA, 32 nt, Human
uggcucacuauaaccucuuccuccaggguuca

SEQ ID NO: 523872 - RNA, 32 nt, Human
uggcucacuccaaccuccaccuuccagguuca

SEQ ID NO: 523873 - RNA, 32 nt, Human
uggcucacuccaaccuccgccuccuggguuca

SEQ ID NO: 523874 - RNA, 32 nt, Human
uggcucacuccaaccuccuccuggguuccagc

SEQ ID NO: 523875 - RNA, 19 nt, Human
uggcucacuccuguaaucc

SEQ ID NO: 523876 - RNA, 20 nt, Human
uggcucacuccuguaauccc

SEQ ID NO: 523877 - RNA, 21 nt, Human
uggcucacuccuguaauccca

SEQ ID NO: 523878 - RNA, 23 nt, Human
uggcucacuccuguaaucccagc

SEQ ID NO: 523879 - RNA, 32 nt, Human
uggcucacuccuguaaucccagcacuuuggag

SEQ ID NO: 523880 - RNA, 32 nt, Human
uggcucacuccuguaaucccagcacuuuggga

SEQ ID NO: 523881 - RNA, 21 nt, Human
uggcucacuccuguaauccua

SEQ ID NO: 523882 - RNA, 21 nt, Human
uggcucacuccuguaaucuca

SEQ ID NO: 523883 - RNA, 32 nt, Human
uggcucacuccuguaauuccagcacuuuggga

SEQ ID NO: 523884 - RNA, 21 nt, Human
uggcucacuccuguaguccca

SEQ ID NO: 523885 - RNA, 21 nt, Human
uggcucacucuuguaauccca

SEQ ID NO: 523886 - RNA, 32 nt, Human
uggcucacugaaaccucugccucccgguucaa

SEQ ID NO: 523887 - RNA, 32 nt, Human
uggcucacugcaaacccgccucccagguuuaa

SEQ ID NO: 523888 - RNA, 32 nt, Human
uggcucacugcaaacuccgccuuccagguuca

SEQ ID NO: 523889 - RNA, 32 nt, Human
uggcucacugcaaacucugccuaccagguuca

SEQ ID NO: 523890 - RNA, 32 nt, Human
uggcucacugcaaacucugccucccagguuca

SEQ ID NO: 523891 - RNA, 32 nt, Human
uggcucacugcaaacucugccuuuuggguuca

SEQ ID NO: 523892 - RNA, 32 nt, Human
uggcucacugcaacauccgccucccggguuca

SEQ ID NO: 523893 - RNA, 32 nt, Human
uggcucacugcaacaucugacuccuggguuca

SEQ ID NO: 523894 - RNA, 32 nt, Human
uggcucacugcaaccacugcuuccuggguuca

SEQ ID NO: 523895 - RNA, 32 nt, Human
uggcucacugcaaccacugucucccggguuca

SEQ ID NO: 523896 - RNA, 32 nt, Human
uggcucacugcaacccccaccucccggguuca

SEQ ID NO: 523897 - RNA, 32 nt, Human
uggcucacugcaacccccgccaccuagguuca

SEQ ID NO: 523898 - RNA, 32 nt, Human
uggcucacugcaacccccgccuccaggguuca

SEQ ID NO: 523899 - RNA, 32 nt, Human
uggcucacugcaaccccgccucccagguucaa

SEQ ID NO: 523900 - RNA, 32 nt, Human
uggcucacugcaacccucccucccggguucca

SEQ ID NO: 523901 - RNA, 32 nt, Human
uggcucacugcaaccucaaccagcccagguuc

SEQ ID NO: 523902 - RNA, 32 nt, Human
uggcucacugcaaccucagccucccagguuca

SEQ ID NO: 523903 - RNA, 32 nt, Human
uggcucacugcaaccuccaacucccugguuca

SEQ ID NO: 523904 - RNA, 32 nt, Human
uggcucacugcaaccuccacccgccggguuca

SEQ ID NO: 523905 - RNA, 32 nt, Human
uggcucacugcaaccuccaccuccagguucaa

SEQ ID NO: 523906 - RNA, 32 nt, Human
uggcucacugcaaccuccaccucccaggucca

SEQ ID NO: 523907 - RNA, 32 nt, Human
uggcucacugcaaccuccaccucccagguuca

SEQ ID NO: 523908 - RNA, 32 nt, Human
uggcucacugcaaccuccaccucccaguucaa

SEQ ID NO: 523909 - RNA, 32 nt, Human
uggcucacugcaaccuccaccucccggguuca

SEQ ID NO: 523910 - RNA, 32 nt, Human
uggcucacugcaaccuccaccucccggguucc

SEQ ID NO: 523911 - RNA, 32 nt, Human
uggcucacugcaaccuccaccuccugggcuca

SEQ ID NO: 523912 - RNA, 32 nt, Human
uggcucacugcaaccuccaccuccugggucaa

SEQ ID NO: 523913 - RNA, 32 nt, Human
uggcucacugcaaccuccaccuccuggguuca

SEQ ID NO: 523914 - RNA, 32 nt, Human
uggcucacugcaaccuccaccucugggauuca

SEQ ID NO: 523915 - RNA, 32 nt, Human
uggcucacugcaaccuccaccuuccugguuca

SEQ ID NO: 523916 - RNA, 32 nt, Human
uggcucacugcaaccuccacuucccagguucu

SEQ ID NO: 523917 - RNA, 32 nt, Human
uggcucacugcaaccuccacuucccggguuca

SEQ ID NO: 523918 - RNA, 32 nt, Human
uggcucacugcaaccuccacuuccuggguuca

SEQ ID NO: 523919 - RNA, 32 nt, Human
uggcucacugcaaccuccacuucucagguuca

SEQ ID NO: 523920 - RNA, 32 nt, Human
uggcucacugcaaccuccaggccagccucagc

SEQ ID NO: 523921 - RNA, 32 nt, Human
uggcucacugcaaccuccaucuccggggcuca

SEQ ID NO: 523922 - RNA, 32 nt, Human
uggcucacugcaaccuccgacucccagguuca

SEQ ID NO: 523923 - RNA, 32 nt, Human
uggcucacugcaaccuccgacucccugguuca

SEQ ID NO: 523924 - RNA, 32 nt, Human
uggcucacugcaaccuccgccuccagggcgca

SEQ ID NO: 523925 - RNA, 32 nt, Human
uggcucacugcaaccuccgccuccaggguucg

SEQ ID NO: 523926 - RNA, 32 nt, Human
uggcucacugcaaccuccgccucccagguuca

SEQ ID NO: 523927 - RNA, 32 nt, Human
uggcucacugcaaccuccgccucccagguucc

SEQ ID NO: 523928 - RNA, 32 nt, Human
uggcucacugcaaccuccgccucccgaguuca

SEQ ID NO: 523929 - RNA, 32 nt, Human
uggcucacugcaaccuccgccucccggguuca

SEQ ID NO: 523930 - RNA, 32 nt, Human
uggcucacugcaaccuccgccucccggguucc

SEQ ID NO: 523931 - RNA, 32 nt, Human
uggcucacugcaaccuccgccucccugguuca

SEQ ID NO: 523932 - RNA, 32 nt, Human
uggcucacugcaaccuccgccuccgggguuca

SEQ ID NO: 523933 - RNA, 32 nt, Human
uggcucacugcaaccuccgccuccuggguuaa

SEQ ID NO: 523934 - RNA, 32 nt, Human
uggcucacugcaaccuccgccuccuggguuca

SEQ ID NO: 523935 - RNA, 32 nt, Human
uggcucacugcaaccuccgccuccuggguucc

SEQ ID NO: 523936 - RNA, 32 nt, Human
uggcucacugcaaccuccgccuccuggguucg

SEQ ID NO: 523937 - RNA, 32 nt, Human
uggcucacugcaaccuccgccucucagguuca

SEQ ID NO: 523938 - RNA, 32 nt, Human
uggcucacugcaaccuccgccucucggguuca

SEQ ID NO: 523939 - RNA, 32 nt, Human
uggcucacugcaaccuccgccucuuggguuca

SEQ ID NO: 523940 - RNA, 32 nt, Human
uggcucacugcaaccuccgccuuccugguuca

SEQ ID NO: 523941 - RNA, 32 nt, Human
uggcucacugcaaccuccgccuucuggguuca

SEQ ID NO: 523942 - RNA, 32 nt, Human
uggcucacugcaaccuccgucucccagguuca

SEQ ID NO: 523943 - RNA, 32 nt, Human
uggcucacugcaaccuccgucuccuggguuca

SEQ ID NO: 523944 - RNA, 32 nt, Human
uggcucacugcaaccuccgucuuccggguuca

SEQ ID NO: 523945 - RNA, 32 nt, Human
uggcucacugcaaccuccuccucccggguuca

SEQ ID NO: 523946 - RNA, 32 nt, Human
uggcucacugcaaccuccugcuuccuggguuc

SEQ ID NO: 523947 - RNA, 32 nt, Human
uggcucacugcaaccucuaccuccuggguuca

SEQ ID NO: 523948 - RNA, 32 nt, Human
uggcucacugcaaccucugccaccuggguuca

SEQ ID NO: 523949 - RNA, 32 nt, Human
uggcucacugcaaccucugccccaccaaaauu

SEQ ID NO: 523950 - RNA, 32 nt, Human
uggcucacugcaaccucugcccccuggguuca

SEQ ID NO: 523951 - RNA, 32 nt, Human
uggcucacugcaaccucugccuaccggauuca

SEQ ID NO: 523952 - RNA, 32 nt, Human
uggcucacugcaaccucugccucacaggcuca

SEQ ID NO: 523953 - RNA, 32 nt, Human
uggcucacugcaaccucugccucacagguuca

SEQ ID NO: 523954 - RNA, 32 nt, Human
uggcucacugcaaccucugccucccagguuca

SEQ ID NO: 523955 - RNA, 32 nt, Human
uggcucacugcaaccucugccucccgggcuca

SEQ ID NO: 523956 - RNA, 32 nt, Human
uggcucacugcaaccucugccucccggguuca

SEQ ID NO: 523957 - RNA, 32 nt, Human
uggcucacugcaaccucugccucccgguuuca

SEQ ID NO: 523958 - RNA, 32 nt, Human
uggcucacugcaaccucugccucccugguuca

SEQ ID NO: 523959 - RNA, 26 nt, Human
uggcucacugcaaccucugccuccug

SEQ ID NO: 523960 - RNA, 32 nt, Human
uggcucacugcaaccucugccuccugaauucc

SEQ ID NO: 523961 - RNA, 32 nt, Human
uggcucacugcaaccucugccuccugggcuca

SEQ ID NO: 523962 - RNA, 32 nt, Human
uggcucacugcaaccucugccuccuggguuca

SEQ ID NO: 523963 - RNA, 32 nt, Human
uggcucacugcaaccucugccuccuucguuca

SEQ ID NO: 523964 - RNA, 32 nt, Human
uggcucacugcaaccucugccuccuugguuca

SEQ ID NO: 523965 - RNA, 32 nt, Human
uggcucacugcaaccucugccugccggguuca

SEQ ID NO: 523966 - RNA, 32 nt, Human
uggcucacugcaaccucugccuucuggguuca

SEQ ID NO: 523967 - RNA, 32 nt, Human
uggcucacugcaaccucugcuucccagguuua

SEQ ID NO: 523968 - RNA, 32 nt, Human
uggcucacugcaaccucugcuucccgaguuca

SEQ ID NO: 523969 - RNA, 32 nt, Human
uggcucacugcaaccucugcuucccggguuca

SEQ ID NO: 523970 - RNA, 32 nt, Human
uggcucacugcaaccucugucucccagguuca

SEQ ID NO: 523971 - RNA, 32 nt, Human
uggcucacugcaaccucugucuccugggcuca

SEQ ID NO: 523972 - RNA, 32 nt, Human
uggcucacugcaaccucugucuuccagguuca

SEQ ID NO: 523973 - RNA, 32 nt, Human
uggcucacugcaaccucuguguccugggcuca

SEQ ID NO: 523974 - RNA, 32 nt, Human
uggcucacugcaaccucuuccuccugguucaa

SEQ ID NO: 523975 - RNA, 32 nt, Human
uggcucacugcaaccugcgccuccuggguuca

SEQ ID NO: 523976 - RNA, 32 nt, Human
uggcucacugcaaccugggugacagaacaaga

SEQ ID NO: 523977 - RNA, 32 nt, Human
uggcucacugcaaccuugaccucccaggcuca

SEQ ID NO: 523978 - RNA, 32 nt, Human
uggcucacugcaaccuugacgucccagguuca

SEQ ID NO: 523979 - RNA, 32 nt, Human
uggcucacugcaacguccgccucccagguuca

SEQ ID NO: 523980 - RNA, 32 nt, Human
uggcucacugcaacgucugccuccuggguuca

SEQ ID NO: 523981 - RNA, 32 nt, Human
uggcucacugcaacucugcuucccagguucaa

SEQ ID NO: 523982 - RNA, 32 nt, Human
uggcucacugcaacugcagccucccggguuca

SEQ ID NO: 523983 - RNA, 32 nt, Human
uggcucacugcaacuuccaccucugggaucaa

SEQ ID NO: 523984 - RNA, 32 nt, Human
uggcucacugcaacuuccacuucccggguuca

SEQ ID NO: 523985 - RNA, 32 nt, Human
uggcucacugcaacuuccgccuccuguguuca

SEQ ID NO: 523986 - RNA, 32 nt, Human
uggcucacugcaacuuccgucucccggguuca

SEQ ID NO: 523987 - RNA, 32 nt, Human
uggcucacugcaacuucuaccuccgagguuca

SEQ ID NO: 523988 - RNA, 32 nt, Human
uggcucacugcaacuucugccaccuggguuca

SEQ ID NO: 523989 - RNA, 32 nt, Human
uggcucacugcaacuucugccucuuggguuca

SEQ ID NO: 523990 - RNA, 32 nt, Human
uggcucacugcaacuucugccuuccagguuca

SEQ ID NO: 523991 - RNA, 32 nt, Human
uggcucacugcaacuugggccucccagguuca

SEQ ID NO: 523992 - RNA, 32 nt, Human
uggcucacugcaagcuccaccuccuggguuca

SEQ ID NO: 523993 - RNA, 32 nt, Human
uggcucacugcaagcuccgccucccagguuca

SEQ ID NO: 523994 - RNA, 32 nt, Human
uggcucacugcaagcuccgccucccagguucc

SEQ ID NO: 523995 - RNA, 32 nt, Human
uggcucacugcaagcuccgccucccgaguuca

SEQ ID NO: 523996 - RNA, 32 nt, Human
uggcucacugcaagcuccgccucccggcuuca

SEQ ID NO: 523997 - RNA, 32 nt, Human
uggcucacugcaagcuccgccucccggguuca

SEQ ID NO: 523998 - RNA, 32 nt, Human
uggcucacugcaagcuccgccuccuggguuca

SEQ ID NO: 523999 - RNA, 32 nt, Human
uggcucacugcaagcuccgccucucggguuug

SEQ ID NO: 524000 - RNA, 32 nt, Human
uggcucacugcaagcuccgucugccggguuca

SEQ ID NO: 524001 - RNA, 32 nt, Human
uggcucacugcaagcucugcccuccccggguu

SEQ ID NO: 524002 - RNA, 32 nt, Human
uggcucacugcaagcucugccucccggguuca

SEQ ID NO: 524003 - RNA, 32 nt, Human
uggcucacugcaagcuuccccuuccggguuca

SEQ ID NO: 524004 - RNA, 32 nt, Human
uggcucacugcaaucuccaucucccggguuca

SEQ ID NO: 524005 - RNA, 32 nt, Human
uggcucacugcaaucuccgccuccccaguuca

SEQ ID NO: 524006 - RNA, 32 nt, Human
uggcucacugcaaucucuauccccuggguuca

SEQ ID NO: 524007 - RNA, 32 nt, Human
uggcucacugcaaucucugccucucggguuca

SEQ ID NO: 524008 - RNA, 32 nt, Human
uggcucacugcaaucucugccuuccggguuca

SEQ ID NO: 524009 - RNA, 32 nt, Human
uggcucacugcaccuccaccuuccgggcucaa

SEQ ID NO: 524010 - RNA, 32 nt, Human
uggcucacugcagccuagaccucccagcugga

SEQ ID NO: 524011 - RNA, 32 nt, Human
uggcucacugcagccucaaccucccaggcuca

SEQ ID NO: 524012 - RNA, 32 nt, Human
uggcucacugcagccuccaccucccaggcuca

SEQ ID NO: 524013 - RNA, 32 nt, Human
uggcucacugcagccuccaccucccagguuca

SEQ ID NO: 524014 - RNA, 32 nt, Human
uggcucacugcagccuccaccuccccgguucc

SEQ ID NO: 524015 - RNA, 32 nt, Human
uggcucacugcagccuccaccucccggguuca

SEQ ID NO: 524016 - RNA, 32 nt, Human
uggcucacugcagccuccaccuccugggcuca

SEQ ID NO: 524017 - RNA, 32 nt, Human
uggcucacugcagccuccaccuccugggcucu

SEQ ID NO: 524018 - RNA, 32 nt, Human
uggcucacugcagccuccaccuccuugacucg

SEQ ID NO: 524019 - RNA, 32 nt, Human
uggcucacugcagccucgaccucccaggcuca

SEQ ID NO: 524020 - RNA, 32 nt, Human
uggcucacugcagccucugccucccaggcuca

SEQ ID NO: 524021 - RNA, 32 nt, Human
uggcucacugcagccucugccucccagguuca

SEQ ID NO: 524022 - RNA, 32 nt, Human
uggcucacugcagccucugccucccggguuca

SEQ ID NO: 524023 - RNA, 32 nt, Human
uggcucacugcagccucugccuccugaguagc

SEQ ID NO: 524024 - RNA, 32 nt, Human
uggcucacugcagccucugccuccuggguuca

SEQ ID NO: 524025 - RNA, 32 nt, Human
uggcucacugcagccucugccuccuggguucc

SEQ ID NO: 524026 - RNA, 32 nt, Human
uggcucacugcagcuuaagcucacugccuggg

SEQ ID NO: 524027 - RNA, 32 nt, Human
uggcucacugcaggcucugccucccgguuuca

SEQ ID NO: 524028 - RNA, 32 nt, Human
uggcucacugcagucucugccucccaggcuca

SEQ ID NO: 524029 - RNA, 32 nt, Human
uggcucacugcaguuucaaccucccagauucc

SEQ ID NO: 524030 - RNA, 32 nt, Human
uggcucacugcggccucugccucccggcuuca

SEQ ID NO: 524031 - RNA, 32 nt, Human
uggcucacugcuaccuccgccucccagguuca

SEQ ID NO: 524032 - RNA, 32 nt, Human
uggcucacugcugcaaccucccccuccugggu

SEQ ID NO: 524033 - RNA, 32 nt, Human
uggcucacuguaaccuccaccucccaggcuca

SEQ ID NO: 524034 - RNA, 32 nt, Human
uggcucacuguaaccuccgccucccagguuca

SEQ ID NO: 524035 - RNA, 32 nt, Human
uggcucacuguaaccucugccuccaggauuca

SEQ ID NO: 524036 - RNA, 32 nt, Human
uggcucacuguaaccucugccucccaggcucg

SEQ ID NO: 524037 - RNA, 32 nt, Human
uggcucacuguaaccucugccucccaguucaa

SEQ ID NO: 524038 - RNA, 32 nt, Human
uggcucacuguagccacaaccucucaggcuca

SEQ ID NO: 524039 - RNA, 32 nt, Human
uggcucacuguagccucgaccuccugggcuca

SEQ ID NO: 524040 - RNA, 32 nt, Human
uggcucacuguagccuugacauccugggcuca

SEQ ID NO: 524041 - RNA, 32 nt, Human
uggcucacuucaaccuccgcccccaagguuca

SEQ ID NO: 524042 - RNA, 32 nt, Human
uggcucacuuuaaccuccacuucccugguuca

SEQ ID NO: 524043 - RNA, 32 nt, Human
uggcucagaagcuuccccacugagcaccuugu

SEQ ID NO: 524044 - RNA, 32 nt, Human
uggcucagaagugggcacugaccagauggccu

SEQ ID NO: 524045 - RNA, 21 nt, Human
uggcucagaccuauaauccca

SEQ ID NO: 524046 - RNA, 32 nt, Human
uggcucagaccuauaaucccagcacuuuggga

SEQ ID NO: 524047 - RNA, 32 nt, Human
uggcucagaccuguaaucccagaacuuuggga

SEQ ID NO: 524048 - RNA, 32 nt, Human
uggcucagcaggcuugccccagagccauggca

SEQ ID NO: 524049 - RNA, 21 nt, Human
uggcucagcaguuaaauccca

SEQ ID NO: 524050 - RNA, 18 nt, Human
uggcucagccacauccca

SEQ ID NO: 524051 - RNA, 32 nt, Human
uggcucagccagcggaauuggccacauuucca

SEQ ID NO: 524052 - RNA, 20 nt, Human
uggcucagccuacaauccca

SEQ ID NO: 524053 - RNA, 21 nt, Human
uggcucagccuuguaauccca

SEQ ID NO: 524054 - RNA, 23 nt, Human
uggcucagccuuguaaucccagc

SEQ ID NO: 524055 - RNA, 20 nt, Human
uggcucagcuucuaauccca

SEQ ID NO: 524056 - RNA, 32 nt, Human
uggcucagcuucuaaucccagcacuuugguag

SEQ ID NO: 524057 - RNA, 18 nt, Human
uggcucaggaagaugcca

SEQ ID NO: 524058 - RNA, 18 nt, Human
uggcucaggagaauccua

SEQ ID NO: 524059 - RNA, 32 nt, Human
uggcucaggagguaguggcagccaugguucau

SEQ ID NO: 524060 - RNA, 23 nt, Human
uggcucaggaggugacagcuuug

SEQ ID NO: 524061 - RNA, 32 nt, Human
uggcucaggaggugacagcuuugggauucgca

SEQ ID NO: 524062 - RNA, 32 nt, Human
uggcucaggagguugaugccaugggaaccuga

SEQ ID NO: 524063 - RNA, 24 nt, Human
uggcucaggagucuuagagcuuua

SEQ ID NO: 524064 - RNA, 18 nt, Human
uggcucaggagugaagcu

SEQ ID NO: 524065 - RNA, 20 nt, Human
uggcucaggcaagggaccca

SEQ ID NO: 524066 - RNA, 21 nt, Human
uggcucaggccaagaucacca

SEQ ID NO: 524067 - RNA, 19 nt, Human
uggcucaggccaaugcaga

SEQ ID NO: 524068 - RNA, 19 nt, Human
uggcucaggcccagcccca

SEQ ID NO: 524069 - RNA, 21 nt, Human
uggcucaggccccugccuccc

SEQ ID NO: 524070 - RNA, 21 nt, Human
uggcucaggccuauaacccca

SEQ ID NO: 524071 - RNA, 32 nt, Human
uggcucaggccuguaaccccaguacuuuggga

SEQ ID NO: 524072 - RNA, 32 nt, Human
uggcucaggccuguaaccucagcacuuuggug

SEQ ID NO: 524073 - RNA, 21 nt, Human
uggcucaggccuguaauccca

SEQ ID NO: 524074 - RNA, 32 nt, Human
uggcucaggccuguaaucccaacacuuuggga

SEQ ID NO: 524075 - RNA, 23 nt, Human
uggcucaggccuguaaucccagc

SEQ ID NO: 524076 - RNA, 32 nt, Human
uggcucaggccuguaaucccagcacuguggga

SEQ ID NO: 524077 - RNA, 32 nt, Human
uggcucaggccuguaaucccagcacuucagga

SEQ ID NO: 524078 - RNA, 32 nt, Human
uggcucaggccuguaaucccagcacuuuccaa

SEQ ID NO: 524079 - RNA, 32 nt, Human
uggcucaggccuguaaucccagcacuuuggga

SEQ ID NO: 524080 - RNA, 32 nt, Human
uggcucaggccuguaaucccagcauuuucaga

SEQ ID NO: 524081 - RNA, 32 nt, Human
uggcucaggccuguaaucccagcauuuuggga

SEQ ID NO: 524082 - RNA, 24 nt, Human
uggcucaggccuguaaucccagcu

SEQ ID NO: 524083 - RNA, 20 nt, Human
uggcucaggccuguaauccu

SEQ ID NO: 524084 - RNA, 21 nt, Human
uggcucaggccuguaauccua

SEQ ID NO: 524085 - RNA, 21 nt, Human
uggcucaggccugucauccca

SEQ ID NO: 524086 - RNA, 32 nt, Human
uggcucaggccugugaucccagcacuuuggga

SEQ ID NO: 524087 - RNA, 20 nt, Human
uggcucaggccuuguuagcc

SEQ ID NO: 524088 - RNA, 19 nt, Human
uggcucaggccuuuuccca

SEQ ID NO: 524089 - RNA, 17 nt, Human
uggcucaggcggcccca

SEQ ID NO: 524090 - RNA, 18 nt, Human
uggcucaggcuaguucca

SEQ ID NO: 524091 - RNA, 22 nt, Human
uggcucaggcugagcugaaaga

SEQ ID NO: 524092 - RNA, 19 nt, Human
uggcucaggcugaucacca

SEQ ID NO: 524093 - RNA, 32 nt, Human
uggcucagggaguggcagaagggccauuuuuc

SEQ ID NO: 524094 - RNA, 32 nt, Human
uggcucagggccuggggcgggguccuggguag

SEQ ID NO: 524095 - RNA, 32 nt, Human
uggcucagggcuccugaggaccuuucccagca

SEQ ID NO: 524096 - RNA, 32 nt, Human
uggcucagggcugggguggcagagggaggccu

SEQ ID NO: 524097 - RNA, 32 nt, Human
uggcucaggguucaucguucugccuuguccac

SEQ ID NO: 524098 - RNA, 17 nt, Human
uggcucaggugaaaucc

SEQ ID NO: 524099 - RNA, 20 nt, Human
uggcucaguaaugcucaaga

SEQ ID NO: 524100 - RNA, 21 nt, Human
uggcucaguacggccacccca

SEQ ID NO: 524101 - RNA, 20 nt, Human
uggcucagucacauauccca

SEQ ID NO: 524102 - RNA, 32 nt, Human
uggcucaguccccagaccgcuguguggcuuug

SEQ ID NO: 524103 - RNA, 32 nt, Human
uggcucagugcaaccuccccaccccgggcucc

SEQ ID NO: 524104 - RNA, 32 nt, Human
uggcucagugcaaccuccgccuccuggguuca

SEQ ID NO: 524105 - RNA, 21 nt, Human
uggcucagugcaauacuccca

SEQ ID NO: 524106 - RNA, 20 nt, Human
uggcucagugcuucauccca

SEQ ID NO: 524107 - RNA, 32 nt, Human
uggcucaguggcuggugguggaccuggagagu

SEQ ID NO: 524108 - RNA, 32 nt, Human
uggcucauacaggagagagggaaggcugccag

SEQ ID NO: 524109 - RNA, 21 nt, Human
uggcucauaccuauaauccua

SEQ ID NO: 524110 - RNA, 24 nt, Human
uggcucauaccuguaaaucccagc

SEQ ID NO: 524111 - RNA, 21 nt, Human
uggcucauaccuguaauccca

SEQ ID NO: 524112 - RNA, 23 nt, Human
uggcucauaccuguaaucccagc

SEQ ID NO: 524113 - RNA, 32 nt, Human
uggcucauaccuguaaucccagcacuuuggga

SEQ ID NO: 524114 - RNA, 32 nt, Human
uggcucauaccuguaaucccagcaguuuggga

SEQ ID NO: 524115 - RNA, 32 nt, Human
uggcucauaccuguaaucccagcauuugggga

SEQ ID NO: 524116 - RNA, 21 nt, Human
uggcucauaccuguaauccua

SEQ ID NO: 524117 - RNA, 23 nt, Human
uggcucauaccuguaauccuagc

SEQ ID NO: 524118 - RNA, 32 nt, Human
uggcucauaccuguaaucucagcacuguggga

SEQ ID NO: 524119 - RNA, 21 nt, Human
uggcucauaccuguaaugcca

SEQ ID NO: 524120 - RNA, 23 nt, Human
uggcucauaccuguaaugccagc

SEQ ID NO: 524121 - RNA, 32 nt, Human
uggcucauaccuguaaugccagcacuuuggga

SEQ ID NO: 524122 - RNA, 24 nt, Human
uggcucauaccuguuaauuccagc

SEQ ID NO: 524123 - RNA, 23 nt, Human
uggcucauaccuguuauaccagc

SEQ ID NO: 524124 - RNA, 32 nt, Human
uggcucauaccuguuauaccagcacuuuggga

SEQ ID NO: 524125 - RNA, 21 nt, Human
uggcucauaccuuuaauccca

SEQ ID NO: 524126 - RNA, 23 nt, Human
uggcucauaccuuuaaucccagc

SEQ ID NO: 524127 - RNA, 21 nt, Human
uggcucauacguguaauccca

SEQ ID NO: 524128 - RNA, 23 nt, Human
uggcucauacguguaaucccagu

SEQ ID NO: 524129 - RNA, 20 nt, Human
uggcucauacuuguaauccc

SEQ ID NO: 524130 - RNA, 32 nt, Human
uggcucauagauggccuccugucugcauccuc

SEQ ID NO: 524131 - RNA, 32 nt, Human
uggcucauaucugugauuccagcacuuugaga

SEQ ID NO: 524132 - RNA, 32 nt, Human
uggcucaucacgaccuucgccucccagguuca

SEQ ID NO: 524133 - RNA, 32 nt, Human
uggcucaucagacugaaacuugcucacagacu

SEQ ID NO: 524134 - RNA, 32 nt, Human
uggcucauccccacugcauucucccccugaca

SEQ ID NO: 524135 - RNA, 21 nt, Human
uggcucaucccuguaauccca

SEQ ID NO: 524136 - RNA, 23 nt, Human
uggcucaucccuguaaucccagc

SEQ ID NO: 524137 - RNA, 32 nt, Human
uggcucaucccuguaaucccagcacuuaagga

SEQ ID NO: 524138 - RNA, 23 nt, Human
uggcucaucccuguaaucccagu

SEQ ID NO: 524139 - RNA, 32 nt, Human
uggcucaucccuguaaucccagugcuuuggga

SEQ ID NO: 524140 - RNA, 21 nt, Human
uggcucaucccuguaauucca

SEQ ID NO: 524141 - RNA, 23 nt, Human
uggcucaucccuguaauuccagc

SEQ ID NO: 524142 - RNA, 32 nt, Human
uggcucaucccuguaauuccagcacuuuggaa

SEQ ID NO: 524143 - RNA, 32 nt, Human
uggcucaucguaaccuccaccucccggguuca

SEQ ID NO: 524144 - RNA, 27 nt, Human
uggcucaugaaacagcagaauuccagc

SEQ ID NO: 524145 - RNA, 32 nt, Human
uggcucaugaacucaaucccugcccagguguu

SEQ ID NO: 524146 - RNA, 21 nt, Human
uggcucaugacuauaauccca

SEQ ID NO: 524147 - RNA, 24 nt, Human
uggcucaugacuauaaucccagcu

SEQ ID NO: 524148 - RNA, 32 nt, Human
uggcucaugacuguaaucccagcacuuuggga

SEQ ID NO: 524149 - RNA, 25 nt, Human
uggcucaugcacaccuguaauccca

SEQ ID NO: 524150 - RNA, 21 nt, Human
uggcucaugcacguaauccca

SEQ ID NO: 524151 - RNA, 32 nt, Human
uggcucaugcauguaaucccagcacuuuggga

SEQ ID NO: 524152 - RNA, 23 nt, Human
uggcucaugccaguuaucccagc

SEQ ID NO: 524153 - RNA, 32 nt, Human
uggcucaugccaguuaucccagcacuuuggga

SEQ ID NO: 524154 - RNA, 21 nt, Human
uggcucaugcccauaauccca

SEQ ID NO: 524155 - RNA, 23 nt, Human
uggcucaugcccauaaucccagc

SEQ ID NO: 524156 - RNA, 32 nt, Human
uggcucaugcccauaaucccagcacuuuggga

SEQ ID NO: 524157 - RNA, 21 nt, Human
uggcucaugcccguaauccca

SEQ ID NO: 524158 - RNA, 23 nt, Human
uggcucaugcccguaaucccagc

SEQ ID NO: 524159 - RNA, 32 nt, Human
uggcucaugcccguaaucccagcacuuuggga

SEQ ID NO: 524160 - RNA, 32 nt, Human
uggcucaugcccguaaucucagcacuuuggga

SEQ ID NO: 524161 - RNA, 20 nt, Human
uggcucaugcccguaauucu

SEQ ID NO: 524162 - RNA, 23 nt, Human
uggcucaugcccguaauuucugc

SEQ ID NO: 524163 - RNA, 21 nt, Human
uggcucaugccgauaauccca

SEQ ID NO: 524164 - RNA, 23 nt, Human
uggcucaugccgauaaucccagc

SEQ ID NO: 524165 - RNA, 32 nt, Human
uggcucaugccuaauccuagcacuuugggagg

SEQ ID NO: 524166 - RNA, 25 nt, Human
uggcucaugccuauaaaauuccagc

SEQ ID NO: 524167 - RNA, 21 nt, Human
uggcucaugccuauaagcacc

SEQ ID NO: 524168 - RNA, 21 nt, Human
uggcucaugccuauaaucagc

SEQ ID NO: 524169 - RNA, 19 nt, Human
uggcucaugccuauaaucc

SEQ ID NO: 524170 - RNA, 23 nt, Human
uggcucaugccuauaauccaagc

SEQ ID NO: 524171 - RNA, 20 nt, Human
uggcucaugccuauaauccc

SEQ ID NO: 524172 - RNA, 21 nt, Human
uggcucaugccuauaauccca

SEQ ID NO: 524173 - RNA, 23 nt, Human
uggcucaugccuauaaucccagc

SEQ ID NO: 524174 - RNA, 32 nt, Human
uggcucaugccuauaaucccagcacuuuagga

SEQ ID NO: 524175 - RNA, 32 nt, Human
uggcucaugccuauaaucccagcacuuugaga

SEQ ID NO: 524176 - RNA, 32 nt, Human
uggcucaugccuauaaucccagcacuuuggca

SEQ ID NO: 524177 - RNA, 32 nt, Human
uggcucaugccuauaaucccagcacuuuggga

SEQ ID NO: 524178 - RNA, 32 nt, Human
uggcucaugccuauaaucccagcacuuuugga

SEQ ID NO: 524179 - RNA, 23 nt, Human
uggcucaugccuauaaucccagu

SEQ ID NO: 524180 - RNA, 23 nt, Human
uggcucaugccuauaaucccggc

SEQ ID NO: 524181 - RNA, 21 nt, Human
uggcucaugccuauaauccua

SEQ ID NO: 524182 - RNA, 23 nt, Human
uggcucaugccuauaauccuagc

SEQ ID NO: 524183 - RNA, 21 nt, Human
uggcucaugccuauaaucuca

SEQ ID NO: 524184 - RNA, 23 nt, Human
uggcucaugccuauaaucucagc

SEQ ID NO: 524185 - RNA, 32 nt, Human
uggcucaugccuauaaucucagcacuuuuggg

SEQ ID NO: 524186 - RNA, 23 nt, Human
uggcucaugccuauaaucuuagc

SEQ ID NO: 524187 - RNA, 21 nt, Human
uggcucaugccuauaauucca

SEQ ID NO: 524188 - RNA, 23 nt, Human
uggcucaugccuauaauuccagc

SEQ ID NO: 524189 - RNA, 32 nt, Human
uggcucaugccuauaauuccagcacuuuggag

SEQ ID NO: 524190 - RNA, 32 nt, Human
uggcucaugccuauaauuccagcacuuuggga

SEQ ID NO: 524191 - RNA, 21 nt, Human
uggcucaugccuauaguccca

SEQ ID NO: 524192 - RNA, 23 nt, Human
uggcucaugccuauagucccagc

SEQ ID NO: 524193 - RNA, 32 nt, Human
uggcucaugccuauagucccagcacuuuggga

SEQ ID NO: 524194 - RNA, 32 nt, Human
uggcucaugccuauauuccagcacuuugggag

SEQ ID NO: 524195 - RNA, 23 nt, Human
uggcucaugccuauauucccagc

SEQ ID NO: 524196 - RNA, 32 nt, Human
uggcucaugccuauauucccagcacuuugaga

SEQ ID NO: 524197 - RNA, 21 nt, Human
uggcucaugccuauuauccca

SEQ ID NO: 524198 - RNA, 23 nt, Human
uggcucaugccuauuaucccagc

SEQ ID NO: 524199 - RNA, 32 nt, Human
uggcucaugccuauuaucccagcacuuuggga

SEQ ID NO: 524200 - RNA, 20 nt, Human
uggcucaugccucagcccgc

SEQ ID NO: 524201 - RNA, 21 nt, Human
uggcucaugccuccaauccca

SEQ ID NO: 524202 - RNA, 23 nt, Human
uggcucaugccuccaaucccagc

SEQ ID NO: 524203 - RNA, 21 nt, Human
uggcucaugccucuaauccca

SEQ ID NO: 524204 - RNA, 23 nt, Human
uggcucaugccucuaaucccagc

SEQ ID NO: 524205 - RNA, 32 nt, Human
uggcucaugccucuaaucccagcacuuuggga

SEQ ID NO: 524206 - RNA, 23 nt, Human
uggcucaugccucuugucccagc

SEQ ID NO: 524207 - RNA, 32 nt, Human
uggcucaugccugaaauccuagcacuuuggga

SEQ ID NO: 524208 - RNA, 32 nt, Human
uggcucaugccugaaauucuagcaguuugaga

SEQ ID NO: 524209 - RNA, 32 nt, Human
uggcucaugccugaaucucagcacuuugggag

SEQ ID NO: 524210 - RNA, 32 nt, Human
uggcucaugccugcaaucccagcacuguagaa

SEQ ID NO: 524211 - RNA, 32 nt, Human
uggcucaugccugcaaucccagcacuuuggga

SEQ ID NO: 524212 - RNA, 23 nt, Human
uggcucaugccugcaauuccagc

SEQ ID NO: 524213 - RNA, 32 nt, Human
uggcucaugccugcaauuccagcacuuuggga

SEQ ID NO: 524214 - RNA, 32 nt, Human
uggcucaugccugcggucccagcuacuuaggg

SEQ ID NO: 524215 - RNA, 23 nt, Human
uggcucaugccuggaaucccagc

SEQ ID NO: 524216 - RNA, 32 nt, Human
uggcucaugccuggaaucccagcacuuugaga

SEQ ID NO: 524217 - RNA, 32 nt, Human
uggcucaugccuggaaucccagcacuuuggga

SEQ ID NO: 524218 - RNA, 21 nt, Human
uggcucaugccuguaaaccca

SEQ ID NO: 524219 - RNA, 23 nt, Human
uggcucaugccuguaaacccagc

SEQ ID NO: 524220 - RNA, 32 nt, Human
uggcucaugccuguaaacccagcacuuuggga

SEQ ID NO: 524221 - RNA, 24 nt, Human
uggcucaugccuguaaaucccagc

SEQ ID NO: 524222 - RNA, 32 nt, Human
uggcucaugccuguaaaucccagcacuuuggu

SEQ ID NO: 524223 - RNA, 21 nt, Human
uggcucaugccuguaacccca

SEQ ID NO: 524224 - RNA, 23 nt, Human
uggcucaugccuguaaccccagc

SEQ ID NO: 524225 - RNA, 32 nt, Human
uggcucaugccuguaaccccagcacuuuggga

SEQ ID NO: 524226 - RNA, 21 nt, Human
uggcucaugccuguaagccca

SEQ ID NO: 524227 - RNA, 23 nt, Human
uggcucaugccuguaagcccagc

SEQ ID NO: 524228 - RNA, 32 nt, Human
uggcucaugccuguaagcccagcacuuuggga

SEQ ID NO: 524229 - RNA, 24 nt, Human
uggcucaugccuguaauagcagcu

SEQ ID NO: 524230 - RNA, 32 nt, Human
uggcucaugccuguaauagcagcuacucggga

SEQ ID NO: 524231 - RNA, 18 nt, Human
uggcucaugccuguaauc

SEQ ID NO: 524232 - RNA, 32 nt, Human
uggcucaugccuguaaucaaucccagcacuuu

SEQ ID NO: 524233 - RNA, 32 nt, Human
uggcucaugccuguaaucauagcauuauggga

SEQ ID NO: 524234 - RNA, 19 nt, Human
uggcucaugccuguaaucc

SEQ ID NO: 524235 - RNA, 20 nt, Human
uggcucaugccuguaaucca

SEQ ID NO: 524236 - RNA, 32 nt, Human
uggcucaugccuguaauccaacauugggaggc

SEQ ID NO: 524237 - RNA, 23 nt, Human
uggcucaugccuguaauccaagc

SEQ ID NO: 524238 - RNA, 32 nt, Human
uggcucaugccuguaauccaagcauuuugaga

SEQ ID NO: 524239 - RNA, 22 nt, Human
uggcucaugccuguaauccagc

SEQ ID NO: 524240 - RNA, 32 nt, Human
uggcucaugccuguaauccagcacuuugggag

SEQ ID NO: 524241 - RNA, 22 nt, Human
uggcucaugccuguaauccagu

SEQ ID NO: 524242 - RNA, 32 nt, Human
uggcucaugccuguaauccaguacuuuaggag

SEQ ID NO: 524243 - RNA, 20 nt, Human
uggcucaugccuguaauccc

SEQ ID NO: 524244 - RNA, 21 nt, Human
uggcucaugccuguaauccca

SEQ ID NO: 524245 - RNA, 32 nt, Human
uggcucaugccuguaaucccaaaacuuuggga

SEQ ID NO: 524246 - RNA, 32 nt, Human
uggcucaugccuguaaucccaacacucuggga

SEQ ID NO: 524247 - RNA, 32 nt, Human
uggcucaugccuguaaucccaacacuuaggga

SEQ ID NO: 524248 - RNA, 32 nt, Human
uggcucaugccuguaaucccaacacuuagggu

SEQ ID NO: 524249 - RNA, 32 nt, Human
uggcucaugccuguaaucccaacacuuugaga

SEQ ID NO: 524250 - RNA, 32 nt, Human
uggcucaugccuguaaucccaacacuuuggga

SEQ ID NO: 524251 - RNA, 32 nt, Human
uggcucaugccuguaaucccaacacuuuuggg

SEQ ID NO: 524252 - RNA, 24 nt, Human
uggcucaugccuguaaucccaacu

SEQ ID NO: 524253 - RNA, 32 nt, Human
uggcucaugccuguaaucccaccacugagguc

SEQ ID NO: 524254 - RNA, 32 nt, Human
uggcucaugccuguaaucccaccacuuuggga

SEQ ID NO: 524255 - RNA, 32 nt, Human
uggcucaugccuguaaucccaccacuuugggu

SEQ ID NO: 524256 - RNA, 22 nt, Human
uggcucaugccuguaaucccag

SEQ ID NO: 524257 - RNA, 32 nt, Human
uggcucaugccuguaaucccagaacuuuggga

SEQ ID NO: 524258 - RNA, 32 nt, Human
uggcucaugccuguaaucccagaauuuuggga

SEQ ID NO: 524259 - RNA, 23 nt, Human
uggcucaugccuguaaucccagc

SEQ ID NO: 524260 - RNA, 32 nt, Human
uggcucaugccuguaaucccagcaauuuagga

SEQ ID NO: 524261 - RNA, 32 nt, Human
uggcucaugccuguaaucccagcacauuggga

SEQ ID NO: 524262 - RNA, 32 nt, Human
uggcucaugccuguaaucccagcacccuggga

SEQ ID NO: 524263 - RNA, 32 nt, Human
uggcucaugccuguaaucccagcaccuugaag

SEQ ID NO: 524264 - RNA, 32 nt, Human
uggcucaugccuguaaucccagcaccuuggga

SEQ ID NO: 524265 - RNA, 32 nt, Human
uggcucaugccuguaaucccagcacuauggga

SEQ ID NO: 524266 - RNA, 32 nt, Human
uggcucaugccuguaaucccagcacucuggaa

SEQ ID NO: 524267 - RNA, 32 nt, Human
uggcucaugccuguaaucccagcacucuggga

SEQ ID NO: 524268 - RNA, 32 nt, Human
uggcucaugccuguaaucccagcacuguaggc

SEQ ID NO: 524269 - RNA, 32 nt, Human
uggcucaugccuguaaucccagcacuguggga

SEQ ID NO: 524270 - RNA, 32 nt, Human
uggcucaugccuguaaucccagcacuuauuuu

SEQ ID NO: 524271 - RNA, 32 nt, Human
uggcucaugccuguaaucccagcacuucagga

SEQ ID NO: 524272 - RNA, 32 nt, Human
uggcucaugccuguaaucccagcacuuggaga

SEQ ID NO: 524273 - RNA, 32 nt, Human
uggcucaugccuguaaucccagcacuugggag

SEQ ID NO: 524274 - RNA, 32 nt, Human
uggcucaugccuguaaucccagcacuugggga

SEQ ID NO: 524275 - RNA, 32 nt, Human
uggcucaugccuguaaucccagcacuuucaaa

SEQ ID NO: 524276 - RNA, 32 nt, Human
uggcucaugccuguaaucccagcacuuucaga

SEQ ID NO: 524277 - RNA, 32 nt, Human
uggcucaugccuguaaucccagcacuuucgga

SEQ ID NO: 524278 - RNA, 32 nt, Human
uggcucaugccuguaaucccagcacuuugaga

SEQ ID NO: 524279 - RNA, 32 nt, Human
uggcucaugccuguaaucccagcacuuugaua

SEQ ID NO: 524280 - RNA, 32 nt, Human
uggcucaugccuguaaucccagcacuuugcga

SEQ ID NO: 524281 - RNA, 32 nt, Human
uggcucaugccuguaaucccagcacuuuggaa

SEQ ID NO: 524282 - RNA, 32 nt, Human
uggcucaugccuguaaucccagcacuuuggga

SEQ ID NO: 524283 - RNA, 32 nt, Human
uggcucaugccuguaaucccagcacuuugggg

SEQ ID NO: 524284 - RNA, 32 nt, Human
uggcucaugccuguaaucccagcacuuuggua

SEQ ID NO: 524285 - RNA, 32 nt, Human
uggcucaugccuguaaucccagcacuuuucgg

SEQ ID NO: 524286 - RNA, 32 nt, Human
uggcucaugccuguaaucccagcacuuuugag

SEQ ID NO: 524287 - RNA, 32 nt, Human
uggcucaugccuguaaucccagcacuuuugga

SEQ ID NO: 524288 - RNA, 32 nt, Human
uggcucaugccuguaaucccagcauuuugaga

SEQ ID NO: 524289 - RNA, 32 nt, Human
uggcucaugccuguaaucccagcauuuuggaa

SEQ ID NO: 524290 - RNA, 32 nt, Human
uggcucaugccuguaaucccagcauuuuggga

SEQ ID NO: 524291 - RNA, 32 nt, Human
uggcucaugccuguaaucccagcauuuuggua

SEQ ID NO: 524292 - RNA, 32 nt, Human
uggcucaugccuguaaucccagcgcuuuggga

SEQ ID NO: 524293 - RNA, 24 nt, Human
uggcucaugccuguaaucccagcu

SEQ ID NO: 524294 - RNA, 32 nt, Human
uggcucaugccuguaaucccagcuacgcagga

SEQ ID NO: 524295 - RNA, 32 nt, Human
uggcucaugccuguaaucccagcuacucagga

SEQ ID NO: 524296 - RNA, 32 nt, Human
uggcucaugccuguaaucccaggacuuuggga

SEQ ID NO: 524297 - RNA, 23 nt, Human
uggcucaugccuguaaucccagu

SEQ ID NO: 524298 - RNA, 32 nt, Human
uggcucaugccuguaaucccaguacuuuggga

SEQ ID NO: 524299 - RNA, 32 nt, Human
uggcucaugccuguaaucccagugcuuuggga

SEQ ID NO: 524300 - RNA, 32 nt, Human
uggcucaugccuguaaucccgacacuuuggga

SEQ ID NO: 524301 - RNA, 32 nt, Human
uggcucaugccuguaaucccggcacuuuggga

SEQ ID NO: 524302 - RNA, 23 nt, Human
uggcucaugccuguaaucccugc

SEQ ID NO: 524303 - RNA, 32 nt, Human
uggcucaugccuguaaucccugcacuuuggga

SEQ ID NO: 524304 - RNA, 23 nt, Human
uggcucaugccuguaauccgagc

SEQ ID NO: 524305 - RNA, 32 nt, Human
uggcucaugccuguaauccgagcacuucggga

SEQ ID NO: 524306 - RNA, 32 nt, Human
uggcucaugccuguaauccgagcacuuuggga

SEQ ID NO: 524307 - RNA, 21 nt, Human
uggcucaugccuguaauccua

SEQ ID NO: 524308 - RNA, 32 nt, Human
uggcucaugccuguaauccuaacacuuuggga

SEQ ID NO: 524309 - RNA, 23 nt, Human
uggcucaugccuguaauccuagc

SEQ ID NO: 524310 - RNA, 32 nt, Human
uggcucaugccuguaauccuagcacuuugaga

SEQ ID NO: 524311 - RNA, 32 nt, Human
uggcucaugccuguaauccuagcacuuuggaa

SEQ ID NO: 524312 - RNA, 32 nt, Human
uggcucaugccuguaauccuagcacuuuggga

SEQ ID NO: 524313 - RNA, 32 nt, Human
uggcucaugccuguaauccuagcacuuugggg

SEQ ID NO: 524314 - RNA, 32 nt, Human
uggcucaugccuguaauccuagcacuuugggu

SEQ ID NO: 524315 - RNA, 32 nt, Human
uggcucaugccuguaauccuagcauuuuggga

SEQ ID NO: 524316 - RNA, 23 nt, Human
uggcucaugccuguaauccuggc

SEQ ID NO: 524317 - RNA, 32 nt, Human
uggcucaugccuguaauccuggcacuuuggga

SEQ ID NO: 524318 - RNA, 21 nt, Human
uggcucaugccuguaaucgca

SEQ ID NO: 524319 - RNA, 23 nt, Human
uggcucaugccuguaaucgcagc

SEQ ID NO: 524320 - RNA, 32 nt, Human
uggcucaugccuguaaucgcagcacuuuggga

SEQ ID NO: 524321 - RNA, 23 nt, Human
uggcucaugccuguaaucguagc

SEQ ID NO: 524322 - RNA, 32 nt, Human
uggcucaugccuguaaucguagcacuuugaga

SEQ ID NO: 524323 - RNA, 19 nt, Human
uggcucaugccuguaaucu

SEQ ID NO: 524324 - RNA, 21 nt, Human
uggcucaugccuguaaucuca

SEQ ID NO: 524325 - RNA, 32 nt, Human
uggcucaugccuguaaucucaacacuuuggga

SEQ ID NO: 524326 - RNA, 22 nt, Human
uggcucaugccuguaaucucag

SEQ ID NO: 524327 - RNA, 32 nt, Human
uggcucaugccuguaaucucagaacuuuggga

SEQ ID NO: 524328 - RNA, 23 nt, Human
uggcucaugccuguaaucucagc

SEQ ID NO: 524329 - RNA, 32 nt, Human
uggcucaugccuguaaucucagcacuguagga

SEQ ID NO: 524330 - RNA, 32 nt, Human
uggcucaugccuguaaucucagcacuuugaga

SEQ ID NO: 524331 - RNA, 32 nt, Human
uggcucaugccuguaaucucagcacuuuggga

SEQ ID NO: 524332 - RNA, 24 nt, Human
uggcucaugccuguaaucucagcu

SEQ ID NO: 524333 - RNA, 32 nt, Human
uggcucaugccuguaaucucagcuacuuggcu

SEQ ID NO: 524334 - RNA, 23 nt, Human
uggcucaugccuguaaucucagu

SEQ ID NO: 524335 - RNA, 32 nt, Human
uggcucaugccuguaaucucaguacauuggga

SEQ ID NO: 524336 - RNA, 32 nt, Human
uggcucaugccuguaaucucaguacuuuggga

SEQ ID NO: 524337 - RNA, 23 nt, Human
uggcucaugccuguaaucugagc

SEQ ID NO: 524338 - RNA, 32 nt, Human
uggcucaugccuguaaucugagcacuuuggga

SEQ ID NO: 524339 - RNA, 32 nt, Human
uggcucaugccuguaaucuuaucacuuuggga

SEQ ID NO: 524340 - RNA, 21 nt, Human
uggcucaugccuguaaugcca

SEQ ID NO: 524341 - RNA, 23 nt, Human
uggcucaugccuguaaugccagc

SEQ ID NO: 524342 - RNA, 32 nt, Human
uggcucaugccuguaaugccagcacuuugcca

SEQ ID NO: 524343 - RNA, 18 nt, Human
uggcucaugccuguaauu

SEQ ID NO: 524344 - RNA, 20 nt, Human
uggcucaugccuguaauucc

SEQ ID NO: 524345 - RNA, 21 nt, Human
uggcucaugccuguaauucca

SEQ ID NO: 524346 - RNA, 23 nt, Human
uggcucaugccuguaauuccagc

SEQ ID NO: 524347 - RNA, 32 nt, Human
uggcucaugccuguaauuccagcacuuuagga

SEQ ID NO: 524348 - RNA, 32 nt, Human
uggcucaugccuguaauuccagcacuuuggga

SEQ ID NO: 524349 - RNA, 32 nt, Human
uggcucaugccuguaauuccggcacuuuggga

SEQ ID NO: 524350 - RNA, 23 nt, Human
uggcucaugccuguaauucuagc

SEQ ID NO: 524351 - RNA, 32 nt, Human
uggcucaugccuguaauuucaguacuuuggga

SEQ ID NO: 524352 - RNA, 19 nt, Human
uggcucaugccuguagucc

SEQ ID NO: 524353 - RNA, 21 nt, Human
uggcucaugccuguaguccca

SEQ ID NO: 524354 - RNA, 23 nt, Human
uggcucaugccuguagucccagc

SEQ ID NO: 524355 - RNA, 32 nt, Human
uggcucaugccuguagucccagcacucgggaa

SEQ ID NO: 524356 - RNA, 32 nt, Human
uggcucaugccuguagucccagcacucugugg

SEQ ID NO: 524357 - RNA, 32 nt, Human
uggcucaugccuguagucccagcacuuuggga

SEQ ID NO: 524358 - RNA, 32 nt, Human
uggcucaugccuguagucccagcacuuugggg

SEQ ID NO: 524359 - RNA, 24 nt, Human
uggcucaugccuguagucccagcu

SEQ ID NO: 524360 - RNA, 32 nt, Human
uggcucaugccuguagucccagcuacucugga

SEQ ID NO: 524361 - RNA, 32 nt, Human
uggcucaugccuguagucccagcuacuuggga

SEQ ID NO: 524362 - RNA, 24 nt, Human
uggcucaugccuguagucccugcu

SEQ ID NO: 524363 - RNA, 32 nt, Human
uggcucaugccuguagucccugcuacuuggga

SEQ ID NO: 524364 - RNA, 32 nt, Human
uggcucaugccuguaguccuagcacuuuggga

SEQ ID NO: 524365 - RNA, 32 nt, Human
uggcucaugccuguaguuccagcgcuuuggga

SEQ ID NO: 524366 - RNA, 21 nt, Human
uggcucaugccuguauaaucc

SEQ ID NO: 524367 - RNA, 23 nt, Human
uggcucaugccuguauaauccca

SEQ ID NO: 524368 - RNA, 32 nt, Human
uggcucaugccuguauaaucccagcacuuugg

SEQ ID NO: 524369 - RNA, 32 nt, Human
uggcucaugccuguauccagcacuuugggagg

SEQ ID NO: 524370 - RNA, 32 nt, Human
uggcucaugccuguaucccagcacuuugggag

SEQ ID NO: 524371 - RNA, 32 nt, Human
uggcucaugccuguauucccaccacuuuggga

SEQ ID NO: 524372 - RNA, 32 nt, Human
uggcucaugccuguauucccaguacuuuggga

SEQ ID NO: 524373 - RNA, 23 nt, Human
uggcucaugccuguauucucagc

SEQ ID NO: 524374 - RNA, 21 nt, Human
uggcucaugccugucauccca

SEQ ID NO: 524375 - RNA, 23 nt, Human
uggcucaugccugucaucccagc

SEQ ID NO: 524376 - RNA, 32 nt, Human
uggcucaugccugucaucccagcacuuuggga

SEQ ID NO: 524377 - RNA, 32 nt, Human
uggcucaugccugucaucccagcauuugggag

SEQ ID NO: 524378 - RNA, 18 nt, Human
uggcucaugccugugauc

SEQ ID NO: 524379 - RNA, 21 nt, Human
uggcucaugccugugauccca

SEQ ID NO: 524380 - RNA, 32 nt, Human
uggcucaugccugugaucccaacacuuuggga

SEQ ID NO: 524381 - RNA, 23 nt, Human
uggcucaugccugugaucccagc

SEQ ID NO: 524382 - RNA, 32 nt, Human
uggcucaugccugugaucccagcacuuuggga

SEQ ID NO: 524383 - RNA, 32 nt, Human
uggcucaugccugugaucccagcacuuugggu

SEQ ID NO: 524384 - RNA, 24 nt, Human
uggcucaugccugugaucccagcu

SEQ ID NO: 524385 - RNA, 32 nt, Human
uggcucaugccugugaucccagcuacucggga

SEQ ID NO: 524386 - RNA, 32 nt, Human
uggcucaugccugugauccuagcacuuugcga

SEQ ID NO: 524387 - RNA, 32 nt, Human
uggcucaugccugugauccuagcacuuuggga

SEQ ID NO: 524388 - RNA, 32 nt, Human
uggcucaugccugugaucgcagcacuuuggga

SEQ ID NO: 524389 - RNA, 32 nt, Human
uggcucaugccuguggucccaacauuuuggga

SEQ ID NO: 524390 - RNA, 23 nt, Human
uggcucaugccuguggucccagc

SEQ ID NO: 524391 - RNA, 32 nt, Human
uggcucaugccuguggucccagcacuuuggga

SEQ ID NO: 524392 - RNA, 32 nt, Human
uggcucaugccuguggucccagcgcuuuggga

SEQ ID NO: 524393 - RNA, 24 nt, Human
uggcucaugccuguggucccagcu

SEQ ID NO: 524394 - RNA, 32 nt, Human
uggcucaugccuguggucccagcuacuugaga

SEQ ID NO: 524395 - RNA, 32 nt, Human
uggcucaugccuguuaucccaacacuuuggga

SEQ ID NO: 524396 - RNA, 32 nt, Human
uggcucaugccuuaaucccagcacuuugggag

SEQ ID NO: 524397 - RNA, 32 nt, Human
uggcucaugccuuaaucccagcacuuuuggag

SEQ ID NO: 524398 - RNA, 21 nt, Human
uggcucaugccuuuaauccca

SEQ ID NO: 524399 - RNA, 23 nt, Human
uggcucaugccuuuaaucccagc

SEQ ID NO: 524400 - RNA, 32 nt, Human
uggcucaugccuuuaaucccagcacuuuggga

SEQ ID NO: 524401 - RNA, 32 nt, Human
uggcucaugcguguaaucccagcacuuuggga

SEQ ID NO: 524402 - RNA, 23 nt, Human
uggcucaugcuacccaauuccag

SEQ ID NO: 524403 - RNA, 18 nt, Human
uggcucaugcuuguaauc

SEQ ID NO: 524404 - RNA, 20 nt, Human
uggcucaugcuuguaauccc

SEQ ID NO: 524405 - RNA, 21 nt, Human
uggcucaugcuuguaauccca

SEQ ID NO: 524406 - RNA, 23 nt, Human
uggcucaugcuuguaaucccagc

SEQ ID NO: 524407 - RNA, 32 nt, Human
uggcucaugcuuguaaucccagcacuugggga

SEQ ID NO: 524408 - RNA, 32 nt, Human
uggcucaugcuuguaaucccagcacuuuggga

SEQ ID NO: 524409 - RNA, 32 nt, Human
uggcucaugcuuguaaucccagcacuuuggua

SEQ ID NO: 524410 - RNA, 23 nt, Human
uggcucaugcuuguaaucccagu

SEQ ID NO: 524411 - RNA, 21 nt, Human
uggcucaugcuuguaauccua

SEQ ID NO: 524412 - RNA, 21 nt, Human
uggcucaugcuuguaaucuca

SEQ ID NO: 524413 - RNA, 32 nt, Human
uggcucaugcuuguaaucucagcacuuuggga

SEQ ID NO: 524414 - RNA, 21 nt, Human
uggcucaugcuuguaauucca

SEQ ID NO: 524415 - RNA, 23 nt, Human
uggcucaugcuuguaauuccagc

SEQ ID NO: 524416 - RNA, 32 nt, Human
uggcucaugcuuguaauuccagcacuguggaa

SEQ ID NO: 524417 - RNA, 32 nt, Human
uggcucauggcagagcauucagugccacgguu

SEQ ID NO: 524418 - RNA, 32 nt, Human
uggcucauggcuacgcuccagccccgggugug

SEQ ID NO: 524419 - RNA, 21 nt, Human
uggcucauguauguaauccua

SEQ ID NO: 524420 - RNA, 21 nt, Human
uggcucaugucuauaauccca

SEQ ID NO: 524421 - RNA, 23 nt, Human
uggcucaugucuauaaucccagc

SEQ ID NO: 524422 - RNA, 32 nt, Human
uggcucaugucuauaaucccagcacuuuggga

SEQ ID NO: 524423 - RNA, 21 nt, Human
uggcucaugucucuaauccca

SEQ ID NO: 524424 - RNA, 23 nt, Human
uggcucaugucucuaaucccagc

SEQ ID NO: 524425 - RNA, 32 nt, Human
uggcucaugucucuaaucccagcacuuuggga

SEQ ID NO: 524426 - RNA, 23 nt, Human
uggcucaugucugcaaucccagc

SEQ ID NO: 524427 - RNA, 21 nt, Human
uggcucaugucuguaauccca

SEQ ID NO: 524428 - RNA, 23 nt, Human
uggcucaugucuguaaucccagc

SEQ ID NO: 524429 - RNA, 32 nt, Human
uggcucaugucuguaaucccagcacucugggg

SEQ ID NO: 524430 - RNA, 32 nt, Human
uggcucaugucuguaaucccagcacuuuggga

SEQ ID NO: 524431 - RNA, 32 nt, Human
uggcucaugucuguaauucuagcauguuagaa

SEQ ID NO: 524432 - RNA, 20 nt, Human
uggcucaugugauccuccca

SEQ ID NO: 524433 - RNA, 25 nt, Human
uggcucaugugauccucccaucuca

SEQ ID NO: 524434 - RNA, 21 nt, Human
uggcucauguguguaauccca

SEQ ID NO: 524435 - RNA, 23 nt, Human
uggcucauguguguaaucccagc

SEQ ID NO: 524436 - RNA, 32 nt, Human
uggcucauguguguaaucccagcacucuggga

SEQ ID NO: 524437 - RNA, 24 nt, Human
uggcucauguuuguaaaucccagc

SEQ ID NO: 524438 - RNA, 32 nt, Human
uggcucauguuuguaaucccagcacuuugggg

SEQ ID NO: 524439 - RNA, 21 nt, Human
uggcucauguuuguaauccua

SEQ ID NO: 524440 - RNA, 32 nt, Human
uggcucauuccaggcuggaauguggauccagc

SEQ ID NO: 524441 - RNA, 21 nt, Human
uggcucauuccuguaauccca

SEQ ID NO: 524442 - RNA, 23 nt, Human
uggcucauuccuguaaucccagc

SEQ ID NO: 524443 - RNA, 32 nt, Human
uggcucauuccuguaaucccagcacuuuggga

SEQ ID NO: 524444 - RNA, 32 nt, Human
uggcucauugcaaccuccgccucccucccagg

SEQ ID NO: 524445 - RNA, 32 nt, Human
uggcucauugcaaccucugccucccaggucag

SEQ ID NO: 524446 - RNA, 32 nt, Human
uggcucauugcaaccuugaauuccugggcaca

SEQ ID NO: 524447 - RNA, 32 nt, Human
uggcucauugcaacuuccacuucccagguuca

SEQ ID NO: 524448 - RNA, 32 nt, Human
uggcucauuugaaaaugaggguccgugguagc

SEQ ID NO: 524449 - RNA, 32 nt, Human
uggcuccaaauacugucauguuuucuugcaca

SEQ ID NO: 524450 - RNA, 22 nt, Human
uggcuccaaggaacagggcugg

SEQ ID NO: 524451 - RNA, 32 nt, Human
uggcuccacaacucgggagccugcgccuuucc

SEQ ID NO: 524452 - RNA, 32 nt, Human
uggcuccaccucuguccucucucuagccugcc

SEQ ID NO: 524453 - RNA, 32 nt, Human
uggcuccagaaaacccgcgccccacauaccug

SEQ ID NO: 524454 - RNA, 32 nt, Human
uggcuccagaagcugccagagugcacuggggg

SEQ ID NO: 524455 - RNA, 32 nt, Human
uggcuccagaucuacucccuguaggaguucaa

SEQ ID NO: 524456 - RNA, 32 nt, Human
uggcuccagcagcugcuguugccaccaccacu

SEQ ID NO: 524457 - RNA, 32 nt, Human
uggcuccagcauggggccuggccaggcuauuc

SEQ ID NO: 524458 - RNA, 32 nt, Human
uggcuccagcuggucccuccauucaggguccc

SEQ ID NO: 524459 - RNA, 32 nt, Human
uggcuccagcuucccuccagccacuccccauu

SEQ ID NO: 524460 - RNA, 32 nt, Human
uggcuccaggaggacuuccugcguccauggaa

SEQ ID NO: 524461 - RNA, 32 nt, Human
uggcuccaggauguuaggaacugugaagaugg

SEQ ID NO: 524462 - RNA, 32 nt, Human
uggcuccagguggucagagaggccaccugggg

SEQ ID NO: 524463 - RNA, 32 nt, Human
uggcuccagguggucaggacaguggggguugg

SEQ ID NO: 524464 - RNA, 32 nt, Human
uggcuccaugacccaccccacucuggaugcca

SEQ ID NO: 524465 - RNA, 19 nt, Human
uggcuccauugguggugaa

SEQ ID NO: 524466 - RNA, 32 nt, Human
uggcucccaaagugcuggaauuacaggcauua

SEQ ID NO: 524467 - RNA, 19 nt, Human
uggcucccacaagcucucc

SEQ ID NO: 524468 - RNA, 21 nt, Human
uggcucccaccuauaauccca

SEQ ID NO: 524469 - RNA, 21 nt, Human
uggcucccaccuauaauccua

SEQ ID NO: 524470 - RNA, 21 nt, Human
uggcucccaccuguaaucuca

SEQ ID NO: 524471 - RNA, 23 nt, Human
uggcucccaccuguaaucucagc

SEQ ID NO: 524472 - RNA, 21 nt, Human
uggcucccaccuguaguccca

SEQ ID NO: 524473 - RNA, 32 nt, Human
uggcucccacuucagugcuguccuccugggcg

SEQ ID NO: 524474 - RNA, 21 nt, Human
uggcucccagcacuuugggag

SEQ ID NO: 524475 - RNA, 21 nt, Human
uggcucccagcauuuugggag

SEQ ID NO: 524476 - RNA, 32 nt, Human
uggcucccagggcagagccucuccuuguacuu

SEQ ID NO: 524477 - RNA, 32 nt, Human
uggcuccccuuuccuuggguccuuguguuccu

SEQ ID NO: 524478 - RNA, 21 nt, Human
uggcucccgccuguaauccca

SEQ ID NO: 524479 - RNA, 32 nt, Human
uggcucccgccuguaaucccagaacuuuggga

SEQ ID NO: 524480 - RNA, 23 nt, Human
uggcucccgccuguaaucccagc

SEQ ID NO: 524481 - RNA, 32 nt, Human
uggcucccgccuguaaucccagcacuuuggga

SEQ ID NO: 524482 - RNA, 23 nt, Human
uggcucccgccuguaaucccagu

SEQ ID NO: 524483 - RNA, 32 nt, Human
uggcucccgccuguaaucccaguacuuuggga

SEQ ID NO: 524484 - RNA, 21 nt, Human
uggcucccgccuguaauccua

SEQ ID NO: 524485 - RNA, 32 nt, Human
uggcucccgccuguaauccuagcacuuuggga

SEQ ID NO: 524486 - RNA, 32 nt, Human
uggcucccggcuuugccugggcugagguuuuu

SEQ ID NO: 524487 - RNA, 32 nt, Human
uggcucccuacaacuuccaccucccagguuca

SEQ ID NO: 524488 - RNA, 32 nt, Human
uggcucccuccagagcaaagggcagguuuguu

SEQ ID NO: 524489 - RNA, 32 nt, Human
uggcucccuccaggcagagccuaagaugcugg

SEQ ID NO: 524490 - RNA, 32 nt, Human
uggcucccucgaccugcuaucuccucugaaag

SEQ ID NO: 524491 - RNA, 32 nt, Human
uggcucccucuacccugccuugaggccuguuu

SEQ ID NO: 524492 - RNA, 32 nt, Human
uggcucccugcaaccuccgccuccuggauucc

SEQ ID NO: 524493 - RNA, 32 nt, Human
uggcucccugcaaccucugcuuccuggguuca

SEQ ID NO: 524494 - RNA, 32 nt, Human
uggcucccuggaggagcucccagucugauggg

SEQ ID NO: 524495 - RNA, 32 nt, Human
uggcucccugucuucagggcuggaagagccac

SEQ ID NO: 524496 - RNA, 32 nt, Human
uggcuccgaacuggcaaccucuuccauugccc

SEQ ID NO: 524497 - RNA, 21 nt, Human
uggcuccgaccuguaauccca

SEQ ID NO: 524498 - RNA, 32 nt, Human
uggcuccgaccuuuguguacacugcagacgcu

SEQ ID NO: 524499 - RNA, 32 nt, Human
uggcuccgagacuggucaggagcccaggccag

SEQ ID NO: 524500 - RNA, 32 nt, Human
uggcuccgcccuugggaacaggcacggaccac

SEQ ID NO: 524501 - RNA, 31 nt, Human
uggcuccgccucucugagccucugucucugc

SEQ ID NO: 524502 - RNA, 32 nt, Human
uggcuccgcgggcacaggccucaccagggagg

SEQ ID NO: 524503 - RNA, 32 nt, Human
uggcuccgcuggcucuggaggcuggaguuccc

SEQ ID NO: 524504 - RNA, 32 nt, Human
uggcuccggaagcagacacaggccaggccugg

SEQ ID NO: 524505 - RNA, 32 nt, Human
uggcuccggcuucaccaacaccauccugcucc

SEQ ID NO: 524506 - RNA, 32 nt, Human
uggcuccuacagccaggccuccuugcuggccg

SEQ ID NO: 524507 - RNA, 17 nt, Human
uggcuccuauaauccca

SEQ ID NO: 524508 - RNA, 32 nt, Human
uggcuccuaucaccugguggucugauucauac

SEQ ID NO: 524509 - RNA, 20 nt, Human
uggcuccucagcuccagcca

SEQ ID NO: 524510 - RNA, 32 nt, Human
uggcuccucaucucuccggucuccgcagacua

SEQ ID NO: 524511 - RNA, 32 nt, Human
uggcuccucccuugcugaccugccccuugcuu

SEQ ID NO: 524512 - RNA, 32 nt, Human
uggcuccuccucagcauggcuuugugucuuuc

SEQ ID NO: 524513 - RNA, 32 nt, Human
uggcuccucgaaguauggaaaaagccauggcg

SEQ ID NO: 524514 - RNA, 32 nt, Human
uggcuccucuacuguuuaacaacauggcuuuc

SEQ ID NO: 524515 - RNA, 21 nt, Human
uggcuccucucgccccuggag

SEQ ID NO: 524516 - RNA, 32 nt, Human
uggcuccucugccugcccccucaggcccccgc

SEQ ID NO: 524517 - RNA, 32 nt, Human
uggcuccucuuuccccagcuucugucugucuc

SEQ ID NO: 524518 - RNA, 20 nt, Human
uggcuccugaagggcuggcu

SEQ ID NO: 524519 - RNA, 32 nt, Human
uggcuccugcacagauccugcuccucuguggc

SEQ ID NO: 524520 - RNA, 32 nt, Human
uggcuccugccuauaaucccagcacuuuggga

SEQ ID NO: 524521 - RNA, 21 nt, Human
uggcuccugccuguaauccca

SEQ ID NO: 524522 - RNA, 23 nt, Human
uggcuccugccuguaaucccagc

SEQ ID NO: 524523 - RNA, 32 nt, Human
uggcuccugccuguaaucccagcacuuuggga

SEQ ID NO: 524524 - RNA, 21 nt, Human
uggcuccugccuguaaucgca

SEQ ID NO: 524525 - RNA, 32 nt, Human
uggcuccugccuguaaucgcagcacuuuggga

SEQ ID NO: 524526 - RNA, 32 nt, Human
uggcuccugcgcgcccuggccugggccuugcc

SEQ ID NO: 524527 - RNA, 32 nt, Human
uggcuccuggaagggaugaggguccagagaaa

SEQ ID NO: 524528 - RNA, 32 nt, Human
uggcuccuggcgcgcaccucugcucccuucuc

SEQ ID NO: 524529 - RNA, 32 nt, Human
uggcuccugggccugggcuuuagucugggcua

SEQ ID NO: 524530 - RNA, 32 nt, Human
uggcuccuguaggggacuggcucucuuggugc

SEQ ID NO: 524531 - RNA, 32 nt, Human
uggcuccuguggccucaccaggaagcgucaga

SEQ ID NO: 524532 - RNA, 24 nt, Human
uggcuccuguuuccacucagcuca

SEQ ID NO: 524533 - RNA, 32 nt, Human
uggcuccuuagacgacagacuaccucacggag

SEQ ID NO: 524534 - RNA, 32 nt, Human
uggcuccuuagaggaaucugggugccugcugu

SEQ ID NO: 524535 - RNA, 32 nt, Human
uggcuccuuagaggaaucugggugccuucugu

SEQ ID NO: 524536 - RNA, 32 nt, Human
uggcuccuugauacaucaguccucaauauuac

SEQ ID NO: 524537 - RNA, 32 nt, Human
uggcuccuuugccucugcuacugaggcagggg

SEQ ID NO: 524538 - RNA, 23 nt, Human
uggcucgaucucagcucacugca

SEQ ID NO: 524539 - RNA, 22 nt, Human
uggcucgaucucggcucacugc

SEQ ID NO: 524540 - RNA, 23 nt, Human
uggcucgaucucugcucacugca

SEQ ID NO: 524541 - RNA, 23 nt, Human
uggcucgaucuuggcucacugca

SEQ ID NO: 524542 - RNA, 21 nt, Human
uggcucgcaccuguaauccca

SEQ ID NO: 524543 - RNA, 23 nt, Human
uggcucgcaccuguaaucccagc

SEQ ID NO: 524544 - RNA, 32 nt, Human
uggcucgcaccuguaaucccagcacuuuggga

SEQ ID NO: 524545 - RNA, 32 nt, Human
uggcucgcaccuguaaucccagcacuuugggg

SEQ ID NO: 524546 - RNA, 32 nt, Human
uggcucgcaccugugggaccucagggcaccgg

SEQ ID NO: 524547 - RNA, 32 nt, Human
uggcucgccuguaaucccagcacuuugggagg

SEQ ID NO: 524548 - RNA, 21 nt, Human
uggcucgcgccuguaauccca

SEQ ID NO: 524549 - RNA, 23 nt, Human
uggcucgcgccuguaaucccagc

SEQ ID NO: 524550 - RNA, 32 nt, Human
uggcucgcgccuguaaucccagcacuuuggga

SEQ ID NO: 524551 - RNA, 21 nt, Human
uggcucgcgcuugugauccca

SEQ ID NO: 524552 - RNA, 32 nt, Human
uggcucgcgcuugugaucccagcacuuuggga

SEQ ID NO: 524553 - RNA, 32 nt, Human
uggcucgcugcaaccucagcuuccagaguuca

SEQ ID NO: 524554 - RNA, 32 nt, Human
uggcucgcugcaaccuccgccucccagguuca

SEQ ID NO: 524555 - RNA, 27 nt, Human
uggcucgcugcaaccucugccuccugg

SEQ ID NO: 524556 - RNA, 32 nt, Human
uggcucgcugcaaccuucacccuucaccuccc

SEQ ID NO: 524557 - RNA, 32 nt, Human
uggcucgcugcagccuccaccucccagguuca

SEQ ID NO: 524558 - RNA, 32 nt, Human
uggcucgcugcgccucugccucccagguucaa

SEQ ID NO: 524559 - RNA, 32 nt, Human
uggcucgcugucccgcagccugggcggggacc

SEQ ID NO: 524560 - RNA, 32 nt, Human
uggcucggccucugccuuugcaccacgggaca

SEQ ID NO: 524561 - RNA, 32 nt, Human
uggcucgggacuucaaaaucagugaugggagu

SEQ ID NO: 524562 - RNA, 21 nt, Human
uggcucgggccuguaauccca

SEQ ID NO: 524563 - RNA, 23 nt, Human
uggcucgggccuguaaucccagc

SEQ ID NO: 524564 - RNA, 32 nt, Human
uggcucgggccuguaaucccagcacuuucgga

SEQ ID NO: 524565 - RNA, 32 nt, Human
uggcucgggggauccagguugcagaugaaaua

SEQ ID NO: 524566 - RNA, 19 nt, Human
uggcucguaccuguaaucc

SEQ ID NO: 524567 - RNA, 32 nt, Human
uggcucguaccuguaauccagcacuuugggaa

SEQ ID NO: 524568 - RNA, 32 nt, Human
uggcucguaucuguaaucccagcacuuugaga

SEQ ID NO: 524569 - RNA, 18 nt, Human
uggcucgugccuguaauc

SEQ ID NO: 524570 - RNA, 21 nt, Human
uggcucgugccuguaauccca

SEQ ID NO: 524571 - RNA, 23 nt, Human
uggcucgugccuguaaucccagc

SEQ ID NO: 524572 - RNA, 32 nt, Human
uggcucgugccuguaaucccagcacuuuggga

SEQ ID NO: 524573 - RNA, 24 nt, Human
uggcucgugccuguaaucccagcu

SEQ ID NO: 524574 - RNA, 21 nt, Human
uggcucgugccuguaaucuca

SEQ ID NO: 524575 - RNA, 24 nt, Human
uggcucgugccuguaaucucagcu

SEQ ID NO: 524576 - RNA, 21 nt, Human
uggcucgugccuguacuccca

SEQ ID NO: 524577 - RNA, 32 nt, Human
uggcucgugccuguacucccagcacuuuggga

SEQ ID NO: 524578 - RNA, 21 nt, Human
uggcucgugccuguaguccca

SEQ ID NO: 524579 - RNA, 32 nt, Human
uggcucgugccuguagucccagcacuuuggga

SEQ ID NO: 524580 - RNA, 32 nt, Human
uggcucgugccugucaucccagcacuuuggga

SEQ ID NO: 524581 - RNA, 32 nt, Human
uggcucgugccugugaucucagcacuugggaa

SEQ ID NO: 524582 - RNA, 21 nt, Human
uggcucgugcuuguaauccca

SEQ ID NO: 524583 - RNA, 23 nt, Human
uggcucgugcuuguaaucccagc

SEQ ID NO: 524584 - RNA, 32 nt, Human
uggcucgugcuuguaaucccagcacuuuggga

SEQ ID NO: 524585 - RNA, 32 nt, Human
uggcucguggccccuuccuccaccuucaagcc

SEQ ID NO: 524586 - RNA, 32 nt, Human
uggcucgugggugagagcaagugaagaccgcc

SEQ ID NO: 524587 - RNA, 32 nt, Human
uggcucuaaggaugaugaguacacuuggaauu

SEQ ID NO: 524588 - RNA, 32 nt, Human
uggcucuaaguggcaggaggaggcggagcauc

SEQ ID NO: 524589 - RNA, 32 nt, Human
uggcucuaaucagcugagacagcaccagagga

SEQ ID NO: 524590 - RNA, 32 nt, Human
uggcucuaccugcagaaagcugcauuuuccaa

SEQ ID NO: 524591 - RNA, 32 nt, Human
uggcucuacuacaaauacaaaaauuagcugga

SEQ ID NO: 524592 - RNA, 32 nt, Human
uggcucuagaaugucuaggaaaaagaagggcu

SEQ ID NO: 524593 - RNA, 32 nt, Human
uggcucuaggcguuuggagaaugcagaaggaa

SEQ ID NO: 524594 - RNA, 31 nt, Human
uggcucuauaugugaccgaugccaagaugga

SEQ ID NO: 524595 - RNA, 32 nt, Human
uggcucucaagcucuguucuucaucgcauucu

SEQ ID NO: 524596 - RNA, 32 nt, Human
uggcucucacaggagcuagcugccugggagga

SEQ ID NO: 524597 - RNA, 32 nt, Human
uggcucucacuccugugcugcagccaccuugu

SEQ ID NO: 524598 - RNA, 23 nt, Human
uggcucucacuuuggagcacuua

SEQ ID NO: 524599 - RNA, 32 nt, Human
uggcucucagaaguccuggauuuuggaaacuc

SEQ ID NO: 524600 - RNA, 32 nt, Human
uggcucucagcccuuggggcauguuaucaugg

SEQ ID NO: 524601 - RNA, 32 nt, Human
uggcucucagcugcacucacagcaccagugag

SEQ ID NO: 524602 - RNA, 18 nt, Human
uggcucucaguaauccca

SEQ ID NO: 524603 - RNA, 32 nt, Human
uggcucucagucuagucaggugcaauguucuu

SEQ ID NO: 524604 - RNA, 32 nt, Human
uggcucucauuagccaggcauggugguacucg

SEQ ID NO: 524605 - RNA, 32 nt, Human
uggcucucauuucacaaauccagccuucccca

SEQ ID NO: 524606 - RNA, 32 nt, Human
uggcucucccagagaggugaaggagcaccugg

SEQ ID NO: 524607 - RNA, 32 nt, Human
uggcucuccgggcaguagagugugugagugca

SEQ ID NO: 524608 - RNA, 32 nt, Human
uggcucuccugaggaugcaccagcgucacccc

SEQ ID NO: 524609 - RNA, 32 nt, Human
uggcucuccuguagcucuccugggguucuggg

SEQ ID NO: 524610 - RNA, 21 nt, Human
uggcucucgccuauaauccca

SEQ ID NO: 524611 - RNA, 21 nt, Human
uggcucucgccuguaauccca

SEQ ID NO: 524612 - RNA, 23 nt, Human
uggcucucgccuguaaucccagc

SEQ ID NO: 524613 - RNA, 32 nt, Human
uggcucucgccuguaaucccagcacuuuggga

SEQ ID NO: 524614 - RNA, 21 nt, Human
uggcucucgccuguaaucuca

SEQ ID NO: 524615 - RNA, 32 nt, Human
uggcucucgccuguaaucucagcacuuuggga

SEQ ID NO: 524616 - RNA, 32 nt, Human
uggcucucucaaggagcuggagggugacagaa

SEQ ID NO: 524617 - RNA, 32 nt, Human
uggcucucucaggaagagggcaggucagggau

SEQ ID NO: 524618 - RNA, 32 nt, Human
uggcucucucaggguccaacaagagcaagcug

SEQ ID NO: 524619 - RNA, 32 nt, Human
uggcucucuccaggauccagaagggguuuggu

SEQ ID NO: 524620 - RNA, 32 nt, Human
uggcucucucucuguaugccucuuccuguucu

SEQ ID NO: 524621 - RNA, 32 nt, Human
uggcucucugcaaagacugccuauacagcuac

SEQ ID NO: 524622 - RNA, 32 nt, Human
uggcucucugcaaccucugccucccagguuca

SEQ ID NO: 524623 - RNA, 19 nt, Human
uggcucugaaacugcucca

SEQ ID NO: 524624 - RNA, 32 nt, Human
uggcucugaggugagagacugaagaagcagag

SEQ ID NO: 524625 - RNA, 32 nt, Human
uggcucugcacacucagguaugugccaaagug

SEQ ID NO: 524626 - RNA, 32 nt, Human
uggcucugcaccugguauaugggucauggacc

SEQ ID NO: 524627 - RNA, 32 nt, Human
uggcucugcaugacaaacacacauccagccca

SEQ ID NO: 524628 - RNA, 32 nt, Human
uggcucugcccagguggggugggguggcccag

SEQ ID NO: 524629 - RNA, 32 nt, Human
uggcucugcccuucuuacugcaaaccaugcug

SEQ ID NO: 524630 - RNA, 32 nt, Human
uggcucugcccuuugggcuggauuacccaugc

SEQ ID NO: 524631 - RNA, 23 nt, Human
uggcucugcggagucccagcaga

SEQ ID NO: 524632 - RNA, 32 nt, Human
uggcucuggaaccaggcugcuccaggaguaag

SEQ ID NO: 524633 - RNA, 32 nt, Human
uggcucuggaaccugggcugagauggauucgg

SEQ ID NO: 524634 - RNA, 32 nt, Human
uggcucuggagauagccccagagcaggguguu

SEQ ID NO: 524635 - RNA, 32 nt, Human
uggcucuggagguggccuguucagugggggca

SEQ ID NO: 524636 - RNA, 32 nt, Human
uggcucuggcagcaggcgggcgcgugggugca

SEQ ID NO: 524637 - RNA, 32 nt, Human
uggcucuggcccaggcuagagugcaguggugc

SEQ ID NO: 524638 - RNA, 32 nt, Human
uggcucuggccgagggcgagacaggaguauuc

SEQ ID NO: 524639 - RNA, 32 nt, Human
uggcucugggaccugggcugggccggaccugg

SEQ ID NO: 524640 - RNA, 32 nt, Human
uggcucugggacuucgcccccuccaguggcuc

SEQ ID NO: 524641 - RNA, 32 nt, Human
uggcucuggggccgagucaccuugcacaagga

SEQ ID NO: 524642 - RNA, 32 nt, Human
uggcucuggggcuggggugagggcuggugguu

SEQ ID NO: 524643 - RNA, 32 nt, Human
uggcucuggguuuggagaacacaguggcuggu

SEQ ID NO: 524644 - RNA, 32 nt, Human
uggcucuggugguucucuccaacauggguguc

SEQ ID NO: 524645 - RNA, 32 nt, Human
uggcucugucaauccaagagcaugccaguuau

SEQ ID NO: 524646 - RNA, 32 nt, Human
uggcucugucccuguguugccuuccacagagg

SEQ ID NO: 524647 - RNA, 32 nt, Human
uggcucugucuguauagcuuguaacaggagcc

SEQ ID NO: 524648 - RNA, 32 nt, Human
uggcucuguggccauucaaccugccaggacua

SEQ ID NO: 524649 - RNA, 32 nt, Human
uggcucugugucaguuuuccauucaguguuaa

SEQ ID NO: 524650 - RNA, 32 nt, Human
uggcucugugugaccauaggcagaugcugacu

SEQ ID NO: 524651 - RNA, 32 nt, Human
uggcucuguuccgagcugcacuuugggcaucc

SEQ ID NO: 524652 - RNA, 32 nt, Human
uggcucuguuggugguccugguguuuuaauga

SEQ ID NO: 524653 - RNA, 32 nt, Human
uggcucuuacuauuuuucacaaaugaguauuc

SEQ ID NO: 524654 - RNA, 32 nt, Human
uggcucuuacucugcaggguuuaauguaggac

SEQ ID NO: 524655 - RNA, 32 nt, Human
uggcucuuagaccucucccaucaugccuugac

SEQ ID NO: 524656 - RNA, 32 nt, Human
uggcucuucacacccaaauagcagacuaaucg

SEQ ID NO: 524657 - RNA, 32 nt, Human
uggcucuucuagcugacucuucugguugggcu

SEQ ID NO: 524658 - RNA, 32 nt, Human
uggcucuucugacauuuaucaggcaccuggua

SEQ ID NO: 524659 - RNA, 32 nt, Human
uggcucuucuuguccuuccucuucucagugca

SEQ ID NO: 524660 - RNA, 21 nt, Human
uggcucuugccuguaauccca

SEQ ID NO: 524661 - RNA, 23 nt, Human
uggcucuugccuguaaucccagc

SEQ ID NO: 524662 - RNA, 32 nt, Human
uggcucuugccuguaaucccagcacuuugaua

SEQ ID NO: 524663 - RNA, 32 nt, Human
uggcucuugccuguaaucccagcacuuuggga

SEQ ID NO: 524664 - RNA, 32 nt, Human
uggcucuugccuguaaucccagcacuuugggg

SEQ ID NO: 524665 - RNA, 32 nt, Human
uggcucuugccuguaauuccagcuacuuggga

SEQ ID NO: 524666 - RNA, 32 nt, Human
uggcucuugccuguagucccggcacuuuggga

SEQ ID NO: 524667 - RNA, 21 nt, Human
uggcucuugcuuccuuucaca

SEQ ID NO: 524668 - RNA, 32 nt, Human
uggcucuuggaaggccagguccccagcucccu

SEQ ID NO: 524669 - RNA, 32 nt, Human
uggcucuugucacccaggcuggagugcagugg

SEQ ID NO: 524670 - RNA, 21 nt, Human
uggcucuugucuguaauccca

SEQ ID NO: 524671 - RNA, 23 nt, Human
uggcucuugucuguaaucccagc

SEQ ID NO: 524672 - RNA, 32 nt, Human
uggcucuuguugcccaggcuggugugcaaugg

SEQ ID NO: 524673 - RNA, 32 nt, Human
uggcucuuuaauguaagccaacauggagagga

SEQ ID NO: 524674 - RNA, 32 nt, Human
uggcucuuucagaagacccaggaagggcagcu

SEQ ID NO: 524675 - RNA, 32 nt, Human
uggcucuuugcaaccucugccuccugggcuca

SEQ ID NO: 524676 - RNA, 32 nt, Human
uggcucuuuucaaccuccuguacagcacccug

SEQ ID NO: 524677 - RNA, 32 nt, Human
uggcucuuuucuccucuuuccuugccucaggg

SEQ ID NO: 524678 - RNA, 32 nt, Human
uggcugaaaaccugauuuucugcugcacgugg

SEQ ID NO: 524679 - RNA, 32 nt, Human
uggcugaaagaguccuuucaggaagguggagc

SEQ ID NO: 524680 - RNA, 32 nt, Human
uggcugaaauacaggggugcauaccaucuugc

SEQ ID NO: 524681 - RNA, 32 nt, Human
uggcugaaauuaggauccagauuucccaaacu

SEQ ID NO: 524682 - RNA, 32 nt, Human
uggcugaacggggagggcaggaagggagggcc

SEQ ID NO: 524683 - RNA, 32 nt, Human
uggcugaagacaguccaccacggaggguccag

SEQ ID NO: 524684 - RNA, 32 nt, Human
uggcugaagcuccuaauauggcaguugugaau

SEQ ID NO: 524685 - RNA, 21 nt, Human
uggcugaagucuguaauccua

SEQ ID NO: 524686 - RNA, 32 nt, Human
uggcugaaguugacaucugaugacaaagcagu

SEQ ID NO: 524687 - RNA, 32 nt, Human
uggcugaauaagaaggaugacagugccuuugu

SEQ ID NO: 524688 - RNA, 32 nt, Human
uggcugaauggggagggcaggaagggaggguc

SEQ ID NO: 524689 - RNA, 19 nt, Human
uggcugacacccuggagaa

SEQ ID NO: 524690 - RNA, 32 nt, Human
uggcugacaccuguaaucccagcacuuuggga

SEQ ID NO: 524691 - RNA, 32 nt, Human
uggcugacagccaggcucuuacuccagccggg

SEQ ID NO: 524692 - RNA, 32 nt, Human
uggcugacaucaaaacagcauucuucuucuag

SEQ ID NO: 524693 - RNA, 32 nt, Human
uggcugacauggugaaacuccaucucuacuaa

SEQ ID NO: 524694 - RNA, 21 nt, Human
uggcugacccccuuccuccca

SEQ ID NO: 524695 - RNA, 32 nt, Human
uggcugaccuuggugagaccuggagcugccug

SEQ ID NO: 524696 - RNA, 32 nt, Human
uggcugacgccuguaaucccagcacuuuggga

SEQ ID NO: 524697 - RNA, 28 nt, Human
uggcugacucaauaaacuuuucccucug

SEQ ID NO: 524698 - RNA, 32 nt, Human
uggcugacugcaacuucugccuccuggguuca

SEQ ID NO: 524699 - RNA, 32 nt, Human
uggcugacuucccuuggccuucccaagagaag

SEQ ID NO: 524700 - RNA, 32 nt, Human
uggcugacuuugccaaccugcccagcugcugc

SEQ ID NO: 524701 - RNA, 18 nt, Human
uggcugagaaaauguaag

SEQ ID NO: 524702 - RNA, 32 nt, Human
uggcugagaaacugggcuggagucaggaggcu

SEQ ID NO: 524703 - RNA, 32 nt, Human
uggcugagaacagugaucucucagcucuccag

SEQ ID NO: 524704 - RNA, 32 nt, Human
uggcugagaggcugcugcuuaucuguucccca

SEQ ID NO: 524705 - RNA, 32 nt, Human
uggcugagaucacaccacuacacuccagccug

SEQ ID NO: 524706 - RNA, 32 nt, Human
uggcugagcaccagcugcgcuucaccugccgc

SEQ ID NO: 524707 - RNA, 32 nt, Human
uggcugagcagagcuugaaggccauucugucu

SEQ ID NO: 524708 - RNA, 32 nt, Human
uggcugagcaggaagggcgaggagacaccuug

SEQ ID NO: 524709 - RNA, 32 nt, Human
uggcugagcccccagccccuggaauaugcagc

SEQ ID NO: 524710 - RNA, 32 nt, Human
uggcugaggaggaugaagaggaauguuugucc

SEQ ID NO: 524711 - RNA, 32 nt, Human
uggcugaggaguaccugcacuaccucagugag

SEQ ID NO: 524712 - RNA, 32 nt, Human
uggcugagggccugggccucaaacagcugcuu

SEQ ID NO: 524713 - RNA, 32 nt, Human
uggcugagguuagugugcuuggaggcugcagg

SEQ ID NO: 524714 - RNA, 32 nt, Human
uggcugagucuggaaugucugccugugccuca

SEQ ID NO: 524715 - RNA, 32 nt, Human
uggcugaucacaucaccucucugccucaguuu

SEQ ID NO: 524716 - RNA, 32 nt, Human
uggcugaucucgaacuccuagacuggggccuu

SEQ ID NO: 524717 - RNA, 23 nt, Human
uggcugaucugcaagacaaagaa

SEQ ID NO: 524718 - RNA, 32 nt, Human
uggcugaucuugaacuccugaccucgggaucc

SEQ ID NO: 524719 - RNA, 23 nt, Human
uggcugaugccuguaaucccagc

SEQ ID NO: 524720 - RNA, 32 nt, Human
uggcugaugccuguaaucccagcacuuuggga

SEQ ID NO: 524721 - RNA, 32 nt, Human
uggcugaugccugucaucccaacgcuuuggga

SEQ ID NO: 524722 - RNA, 32 nt, Human
uggcugcaaaagcagagguugcccguggcuuu

SEQ ID NO: 524723 - RNA, 32 nt, Human
uggcugcaaagggcuguguccugacucugcag

SEQ ID NO: 524724 - RNA, 32 nt, Human
uggcugcaacccacggugguauguuaguguuu

SEQ ID NO: 524725 - RNA, 32 nt, Human
uggcugcaauccagccagagacaggcgcaggu

SEQ ID NO: 524726 - RNA, 32 nt, Human
uggcugcacacagcagcuuccuugguagugua

SEQ ID NO: 524727 - RNA, 32 nt, Human
uggcugcacaggggugaagcucagggacaagu

SEQ ID NO: 524728 - RNA, 21 nt, Human
uggcugcaccccuuccuacca

SEQ ID NO: 524729 - RNA, 32 nt, Human
uggcugcaccucuuuaucaugccuguauuggc

SEQ ID NO: 524730 - RNA, 32 nt, Human
uggcugcaccuuggcggcuccccagagcgcgc

SEQ ID NO: 524731 - RNA, 32 nt, Human
uggcugcagagcagugggccuggccagcaggu

SEQ ID NO: 524732 - RNA, 32 nt, Human
uggcugcagaggccaucgcagcuuuugaaaag

SEQ ID NO: 524733 - RNA, 32 nt, Human
uggcugcagauccggagccaggagcucaacca

SEQ ID NO: 524734 - RNA, 32 nt, Human
uggcugcagaugccaagcagugcucggagauu

SEQ ID NO: 524735 - RNA, 32 nt, Human
uggcugcagcaacucccugacacucaggaagg

SEQ ID NO: 524736 - RNA, 32 nt, Human
uggcugcagccucagagcccucccagguugcu

SEQ ID NO: 524737 - RNA, 32 nt, Human
uggcugcagccugggagcucggccucccucgg

SEQ ID NO: 524738 - RNA, 32 nt, Human
uggcugcagcggggccagagcagcaauggcgg

SEQ ID NO: 524739 - RNA, 32 nt, Human
uggcugcagcucuucucucgggaccaggccua

SEQ ID NO: 524740 - RNA, 32 nt, Human
uggcugcaggcugagcucuaaccagauaacau

SEQ ID NO: 524741 - RNA, 32 nt, Human
uggcugcagggagguacaaaaggggcugggaa

SEQ ID NO: 524742 - RNA, 24 nt, Human
uggcugcaguggcucaugccugua

SEQ ID NO: 524743 - RNA, 32 nt, Human
uggcugcaucacagccacuggcugguccuauu

SEQ ID NO: 524744 - RNA, 22 nt, Human
uggcugcaucucccuuuccucu

SEQ ID NO: 524745 - RNA, 22 nt, Human
uggcugccaaggcacucacaga

SEQ ID NO: 524746 - RNA, 32 nt, Human
uggcugccaaucucccugcucuugguucuccu

SEQ ID NO: 524747 - RNA, 32 nt, Human
uggcugccacccucccuccugccuguguccca

SEQ ID NO: 524748 - RNA, 32 nt, Human
uggcugccaccucuccauccccuaggcuuuca

SEQ ID NO: 524749 - RNA, 25 nt, Human
uggcugccaccugcagauuccagcu

SEQ ID NO: 524750 - RNA, 32 nt, Human
uggcugccagccuacccugccugcacuccucc

SEQ ID NO: 524751 - RNA, 32 nt, Human
uggcugccaggcagcacacccaggaggccggc

SEQ ID NO: 524752 - RNA, 32 nt, Human
uggcugccaguggcugaugggucccggugaug

SEQ ID NO: 524753 - RNA, 32 nt, Human
uggcugccaguguggcacauucaugucaaaau

SEQ ID NO: 524754 - RNA, 18 nt, Human
uggcugccaguugugcug

SEQ ID NO: 524755 - RNA, 32 nt, Human
uggcugccauccagcgccagcacacaguaaug

SEQ ID NO: 524756 - RNA, 32 nt, Human
uggcugccaugucccaauccuuccagcucuug

SEQ ID NO: 524757 - RNA, 32 nt, Human
uggcugcccaggagaaaagaagacauucuaau

SEQ ID NO: 524758 - RNA, 32 nt, Human
uggcugcccaggagacagaccacuugccacgc

SEQ ID NO: 524759 - RNA, 32 nt, Human
uggcugcccaggcugaauggcagugccugggg

SEQ ID NO: 524760 - RNA, 20 nt, Human
uggcugcccccauuccugcu

SEQ ID NO: 524761 - RNA, 32 nt, Human
uggcugccccuccccuccggcccucuccacug

SEQ ID NO: 524762 - RNA, 32 nt, Human
uggcugcccuggaggagcacguggcugaugag

SEQ ID NO: 524763 - RNA, 32 nt, Human
uggcugccgccgcaccagccucaguggcagau

SEQ ID NO: 524764 - RNA, 32 nt, Human
uggcugccggcaccgcccuccugcugccagag

SEQ ID NO: 524765 - RNA, 32 nt, Human
uggcugccgucagcuucacagcuuaccucucc

SEQ ID NO: 524766 - RNA, 19 nt, Human
uggcugccuccuaauccca

SEQ ID NO: 524767 - RNA, 32 nt, Human
uggcugccugggacuggggccucucuccauca

SEQ ID NO: 524768 - RNA, 32 nt, Human
uggcugccugggcaccucucccaggaaguggu

SEQ ID NO: 524769 - RNA, 18 nt, Human
uggcugccuguaauccca

SEQ ID NO: 524770 - RNA, 32 nt, Human
uggcugccuguaaucccagcacuuugggaggc

SEQ ID NO: 524771 - RNA, 19 nt, Human
uggcugcgaccccccggga

SEQ ID NO: 524772 - RNA, 32 nt, Human
uggcugcggcagcaggggacuagcgugaaagu

SEQ ID NO: 524773 - RNA, 32 nt, Human
uggcugcuaccucccucacucuugucagaguc

SEQ ID NO: 524774 - RNA, 32 nt, Human
uggcugcuacugcccaccaggccagguacuga

SEQ ID NO: 524775 - RNA, 31 nt, Human
uggcugcucaauaaacacuuguugaaccauc

SEQ ID NO: 524776 - RNA, 32 nt, Human
uggcugcucagcugccuccuuuuaccuucuga

SEQ ID NO: 524777 - RNA, 32 nt, Human
uggcugcucccagggcugcaccugccaggacc

SEQ ID NO: 524778 - RNA, 32 nt, Human
uggcugcucgcaucugcaggaagcaugguggg

SEQ ID NO: 524779 - RNA, 32 nt, Human
uggcugcucuacugcuuccccuccugucucca

SEQ ID NO: 524780 - RNA, 22 nt, Human
uggcugcucugaucuggucuca

SEQ ID NO: 524781 - RNA, 32 nt, Human
uggcugcugagaugaaugugaaccagguugca

SEQ ID NO: 524782 - RNA, 32 nt, Human
uggcugcugccgcugccuccuccuggguaagg

SEQ ID NO: 524783 - RNA, 21 nt, Human
uggcugcugcggucagggaga

SEQ ID NO: 524784 - RNA, 32 nt, Human
uggcugcugcugcugcuuacuccugaggguga

SEQ ID NO: 524785 - RNA, 23 nt, Human
uggcugcuggaauuggagauagg

SEQ ID NO: 524786 - RNA, 24 nt, Human
uggcugcuggaguuuuccuucuga

SEQ ID NO: 524787 - RNA, 32 nt, Human
uggcugcuggcccauccugccugggcaucccu

SEQ ID NO: 524788 - RNA, 23 nt, Human
uggcugcuggcccuuugcccuug

SEQ ID NO: 524789 - RNA, 32 nt, Human
uggcugcugguguguggggucaguuccagcag

SEQ ID NO: 524790 - RNA, 32 nt, Human
uggcugcuguauccccaagaaucaugucugcg

SEQ ID NO: 524791 - RNA, 32 nt, Human
uggcugcugucaucuguccccaggguugaccu

SEQ ID NO: 524792 - RNA, 21 nt, Human
uggcugcugugagcccgcaga

SEQ ID NO: 524793 - RNA, 32 nt, Human
uggcugcuguugauggagucagacaguaaaca

SEQ ID NO: 524794 - RNA, 32 nt, Human
uggcugcuguugggagcuccacuggacuucug

SEQ ID NO: 524795 - RNA, 32 nt, Human
uggcugcuuaaaauaagcaaaaauuggaugca

SEQ ID NO: 524796 - RNA, 32 nt, Human
uggcugcuucgguaucacagacacucugacuc

SEQ ID NO: 524797 - RNA, 32 nt, Human
uggcugcuuucaucugaagcgccacuucucag

SEQ ID NO: 524798 - RNA, 32 nt, Human
uggcugcuuugugucaccucagugacuuacag

SEQ ID NO: 524799 - RNA, 32 nt, Human
uggcuggaaagccacgcguaugcugcccucua

SEQ ID NO: 524800 - RNA, 32 nt, Human
uggcuggaagaaaacggcggguggguggagga

SEQ ID NO: 524801 - RNA, 32 nt, Human
uggcuggacaggcgggugugaggaguugcaga

SEQ ID NO: 524802 - RNA, 16 nt, Human
uggcuggaccugcagc

SEQ ID NO: 524803 - RNA, 32 nt, Human
uggcuggacgcuggagcccuccuuuaaaggau

SEQ ID NO: 524804 - RNA, 32 nt, Human
uggcuggacuggaacccagauucugugguugc

SEQ ID NO: 524805 - RNA, 31 nt, Human
uggcuggacuuuaccaggcaugcagaagccu

SEQ ID NO: 524806 - RNA, 32 nt, Human
uggcuggagaagaaaggacaagaggcagcagg

SEQ ID NO: 524807 - RNA, 32 nt, Human
uggcuggagacccuccgcaugcaccuggccgg

SEQ ID NO: 524808 - RNA, 32 nt, Human
uggcuggagcagcaucgguccgggaggucucu

SEQ ID NO: 524809 - RNA, 32 nt, Human
uggcuggagcagcugggacacagggcaccaag

SEQ ID NO: 524810 - RNA, 32 nt, Human
uggcuggagcaguacuacgugggagagcuccg

SEQ ID NO: 524811 - RNA, 32 nt, Human
uggcuggagcccagaaaaagaagcaugugguu

SEQ ID NO: 524812 - RNA, 32 nt, Human
uggcuggagcuagagguggcagagagggggug

SEQ ID NO: 524813 - RNA, 32 nt, Human
uggcuggaggaggcaagggguaguguggcugg

SEQ ID NO: 524814 - RNA, 32 nt, Human
uggcuggagggccugggggcugugggaaagug

SEQ ID NO: 524815 - RNA, 32 nt, Human
uggcuggaggugcagggccaggaggaacauga

SEQ ID NO: 524816 - RNA, 32 nt, Human
uggcuggagucucaggccaaauugcagagggu

SEQ ID NO: 524817 - RNA, 31 nt, Human
uggcuggaguggccaaauaggagggagacug

SEQ ID NO: 524818 - RNA, 32 nt, Human
uggcuggaguucagugacaugaucucaggcuu

SEQ ID NO: 524819 - RNA, 23 nt, Human
uggcuggaucucagcucacugca

SEQ ID NO: 524820 - RNA, 32 nt, Human
uggcuggauggacagugaggaagccuguaccu

SEQ ID NO: 524821 - RNA, 32 nt, Human
uggcuggauuucuucugccauuguuuuaaaga

SEQ ID NO: 524822 - RNA, 32 nt, Human
uggcuggcacagugccuggcgccagaauaaga

SEQ ID NO: 524823 - RNA, 32 nt, Human
uggcuggcagaggcacaugcagacccuaccug

SEQ ID NO: 524824 - RNA, 32 nt, Human
uggcuggcaggcaccguggugugagcggaaga

SEQ ID NO: 524825 - RNA, 32 nt, Human
uggcuggcaggcaggacugggaucgaggccca

SEQ ID NO: 524826 - RNA, 32 nt, Human
uggcuggcaucugcuuuauucccauugcuguc

SEQ ID NO: 524827 - RNA, 32 nt, Human
uggcuggcccugugugggguggguacacugga

SEQ ID NO: 524828 - RNA, 32 nt, Human
uggcuggccgggaagguggauucgccuuggcu

SEQ ID NO: 524829 - RNA, 32 nt, Human
uggcuggccugauguuuuguugacagugaacc

SEQ ID NO: 524830 - RNA, 32 nt, Human
uggcuggccugccauuugccucuccccggaga

SEQ ID NO: 524831 - RNA, 32 nt, Human
uggcuggcgacacuggugauaauggucaccug

SEQ ID NO: 524832 - RNA, 24 nt, Human
uggcuggcgccuguaaucccagcu

SEQ ID NO: 524833 - RNA, 32 nt, Human
uggcuggcguggcaagggcaugcucuggggca

SEQ ID NO: 524834 - RNA, 32 nt, Human
uggcuggcuaacuucauggauaagcuacaaau

SEQ ID NO: 524835 - RNA, 32 nt, Human
uggcuggcuccucuggcugauggcauguugag

SEQ ID NO: 524836 - RNA, 32 nt, Human
uggcuggcuccuggcccuacuuggggugaugg

SEQ ID NO: 524837 - RNA, 32 nt, Human
uggcuggcucuuucuuuguucagaccucugca

SEQ ID NO: 524838 - RNA, 32 nt, Human
uggcuggcuggcucccuggcaucagugguuug

SEQ ID NO: 524839 - RNA, 32 nt, Human
uggcuggcuggcugcugggugcacuuacccuc

SEQ ID NO: 524840 - RNA, 32 nt, Human
uggcuggcuggcuggcugcuugacccagugug

SEQ ID NO: 524841 - RNA, 32 nt, Human
uggcuggcugggccccucucagcugcugggcc

SEQ ID NO: 524842 - RNA, 32 nt, Human
uggcuggcuggguccccuucgcaguguuuguc

SEQ ID NO: 524843 - RNA, 32 nt, Human
uggcuggcuguggucagggugcuacuagcacc

SEQ ID NO: 524844 - RNA, 32 nt, Human
uggcuggcuuuucuucuucuucuggugaaguc

SEQ ID NO: 524845 - RNA, 32 nt, Human
uggcugggaaagagggaugugcagugacgugg

SEQ ID NO: 524846 - RNA, 32 nt, Human
uggcugggaaccucaaagaggcuccacaaugu

SEQ ID NO: 524847 - RNA, 32 nt, Human
uggcugggaacugggagaagagcuggagcaac

SEQ ID NO: 524848 - RNA, 32 nt, Human
uggcugggaagagaggaggaguggcagaagaa

SEQ ID NO: 524849 - RNA, 32 nt, Human
uggcugggacacggagaggcagguguggcgua

SEQ ID NO: 524850 - RNA, 31 nt, Human
uggcugggacguggcucagccagcacuuguc

SEQ ID NO: 524851 - RNA, 32 nt, Human
uggcugggagagaagccagccaggcugcacuu

SEQ ID NO: 524852 - RNA, 32 nt, Human
uggcugggagagauggauggcgggaaaggggc

SEQ ID NO: 524853 - RNA, 32 nt, Human
uggcugggcagcacgucucuccccacagggcu

SEQ ID NO: 524854 - RNA, 24 nt, Human
uggcugggcagccccaggggccag

SEQ ID NO: 524855 - RNA, 32 nt, Human
uggcugggcaggcacaggcagugaggccgagg

SEQ ID NO: 524856 - RNA, 32 nt, Human
uggcugggccucuggauggaaggucuggucuu

SEQ ID NO: 524857 - RNA, 32 nt, Human
uggcugggccugggacaggcuccuccucuccc

SEQ ID NO: 524858 - RNA, 32 nt, Human
uggcugggcuaggcagggcagccccagcacgg

SEQ ID NO: 524859 - RNA, 32 nt, Human
uggcugggcuauuccauccaucuggaagcaca

SEQ ID NO: 524860 - RNA, 32 nt, Human
uggcugggcucuguguguggccuguguccccu

SEQ ID NO: 524861 - RNA, 32 nt, Human
uggcugggcugcagauaacuucguuaggcaga

SEQ ID NO: 524862 - RNA, 32 nt, Human
uggcugggcuggcggaggccuugcugaugaac

SEQ ID NO: 524863 - RNA, 32 nt, Human
uggcugggcuuccuguuuccagaugcauuccu

SEQ ID NO: 524864 - RNA, 32 nt, Human
uggcuggggaaagagauagaagcuguauaaac

SEQ ID NO: 524865 - RNA, 32 nt, Human
uggcuggggaggcggacgaugaggagugaugg

SEQ ID NO: 524866 - RNA, 32 nt, Human
uggcuggggagggagaggaugggaccagguug

SEQ ID NO: 524867 - RNA, 32 nt, Human
uggcuggggcacuuaugcucccagagccuuug

SEQ ID NO: 524868 - RNA, 32 nt, Human
uggcugggggaagcugggcgugguuagccugg

SEQ ID NO: 524869 - RNA, 32 nt, Human
uggcugggggugcagaagggcaggguaguucu

SEQ ID NO: 524870 - RNA, 32 nt, Human
uggcugggguagagagaagcagggguauuucu

SEQ ID NO: 524871 - RNA, 32 nt, Human
uggcugggguugacucucaggcucccggcugu

SEQ ID NO: 524872 - RNA, 17 nt, Human
uggcugggucccccagc

SEQ ID NO: 524873 - RNA, 32 nt, Human
uggcugggugcagugaauggccagcggguuuc

SEQ ID NO: 524874 - RNA, 32 nt, Human
uggcuggguggaagaaggguguggaagguaug

SEQ ID NO: 524875 - RNA, 32 nt, Human
uggcugggugucaaggagcaggcuccaggcca

SEQ ID NO: 524876 - RNA, 32 nt, Human
uggcuggguguuuucaaaugucagcuuaaaau

SEQ ID NO: 524877 - RNA, 32 nt, Human
uggcugguaaauucaccuuccugggccucagu

SEQ ID NO: 524878 - RNA, 32 nt, Human
uggcuggucaccugccuuaggcuccacagccc

SEQ ID NO: 524879 - RNA, 32 nt, Human
uggcugguccccaagcaaaacagaaugggcuu

SEQ ID NO: 524880 - RNA, 32 nt, Human
uggcuggucucaaacuccugaccucaaaugau

SEQ ID NO: 524881 - RNA, 32 nt, Human
uggcuggucucaaacuccugaccucaggcgau

SEQ ID NO: 524882 - RNA, 32 nt, Human
uggcuggucucaaacuccugaccuuauaaucc

SEQ ID NO: 524883 - RNA, 32 nt, Human
uggcuggucucaaacuccuggccucaggugau

SEQ ID NO: 524884 - RNA, 32 nt, Human
uggcuggucucaaacuccugggcucaagugau

SEQ ID NO: 524885 - RNA, 32 nt, Human
uggcuggucuccaacuccugaccucgggugau

SEQ ID NO: 524886 - RNA, 32 nt, Human
uggcuggucucgaacuccugaacgcaagugau

SEQ ID NO: 524887 - RNA, 32 nt, Human
uggcuggucucgaacuccugaccucaggugau

SEQ ID NO: 524888 - RNA, 32 nt, Human
uggcuggucucgacuccugaccucaggugauc

SEQ ID NO: 524889 - RNA, 32 nt, Human
uggcuggugagcuuggcgggucugugggcacg

SEQ ID NO: 524890 - RNA, 21 nt, Human
uggcuggugccuguaguccca

SEQ ID NO: 524891 - RNA, 24 nt, Human
uggcuggugccuguagucccagcu

SEQ ID NO: 524892 - RNA, 32 nt, Human
uggcuggugccuguagucccagcuacucagga

SEQ ID NO: 524893 - RNA, 32 nt, Human
uggcuggugucccuugucuuugccaaguucuc

SEQ ID NO: 524894 - RNA, 21 nt, Human
uggcuggugucuguaauccca

SEQ ID NO: 524895 - RNA, 24 nt, Human
uggcuggugucuguaaucccagcu

SEQ ID NO: 524896 - RNA, 32 nt, Human
uggcugguguugaacuccuaaccucaggugau

SEQ ID NO: 524897 - RNA, 32 nt, Human
uggcugguuccagaacgucucucaccuagacc

SEQ ID NO: 524898 - RNA, 32 nt, Human
uggcugguuccauuuccuuggcucucacugcu

SEQ ID NO: 524899 - RNA, 32 nt, Human
uggcugguucccaggcugcgcugguguucagc

SEQ ID NO: 524900 - RNA, 21 nt, Human
uggcuguaagguuugcccuug

SEQ ID NO: 524901 - RNA, 32 nt, Human
uggcuguaauggcauuuaaagcaaacaaacaa

SEQ ID NO: 524902 - RNA, 32 nt, Human
uggcuguaccugguguccugggugacacagga

SEQ ID NO: 524903 - RNA, 32 nt, Human
uggcuguagcugugcucuggguccccaggucc

SEQ ID NO: 524904 - RNA, 32 nt, Human
uggcuguaugaaacuugacggcgcuuuuguaa

SEQ ID NO: 524905 - RNA, 32 nt, Human
uggcuguaugugggugggcauguggccucccc

SEQ ID NO: 524906 - RNA, 32 nt, Human
uggcugucagccagccaagugaaggaccucuc

SEQ ID NO: 524907 - RNA, 32 nt, Human
uggcugucagcccauagguuugucaguuucac

SEQ ID NO: 524908 - RNA, 32 nt, Human
uggcugucagcucugggcugggcuuucugggg

SEQ ID NO: 524909 - RNA, 32 nt, Human
uggcugucaguggacauggggagcuggaugga

SEQ ID NO: 524910 - RNA, 32 nt, Human
uggcugucaguggcagaguuuggcugugaccu

SEQ ID NO: 524911 - RNA, 32 nt, Human
uggcuguccaugacugaagcauggacaacugu

SEQ ID NO: 524912 - RNA, 32 nt, Human
uggcuguccuuugaaagaaagaaguaauguuc

SEQ ID NO: 524913 - RNA, 21 nt, Human
uggcugucgccuguaaugcca

SEQ ID NO: 524914 - RNA, 32 nt, Human
uggcugucgccuguaaugccagcgcuuuggga

SEQ ID NO: 524915 - RNA, 32 nt, Human
uggcugucggcucuucagcucucccgcucggc

SEQ ID NO: 524916 - RNA, 32 nt, Human
uggcugucgggagcuguaucaccuggguucug

SEQ ID NO: 524917 - RNA, 19 nt, Human
uggcugucuagaaugugga

SEQ ID NO: 524918 - RNA, 32 nt, Human
uggcugucucacaggucacagagccauuacaa

SEQ ID NO: 524919 - RNA, 32 nt, Human
uggcugucuccucucuccgccauggcgugugc

SEQ ID NO: 524920 - RNA, 32 nt, Human
uggcugucucuagcgagggguggagaaucaga

SEQ ID NO: 524921 - RNA, 32 nt, Human
uggcugucucucccuuucucccccucucucuc

SEQ ID NO: 524922 - RNA, 32 nt, Human
uggcugucucucucacacagauacacgugcgc

SEQ ID NO: 524923 - RNA, 32 nt, Human
uggcugucuggccccagccucugcacuugggc

SEQ ID NO: 524924 - RNA, 32 nt, Human
uggcugucuggcuggcgaggagcugcugcgcu

SEQ ID NO: 524925 - RNA, 32 nt, Human
uggcugucuguccauucauccugcugcucuga

SEQ ID NO: 524926 - RNA, 32 nt, Human
uggcugucuguggagcuagcugagccaugcgu

SEQ ID NO: 524927 - RNA, 32 nt, Human
uggcugucuucuauaaagguaaaacucuaaac

SEQ ID NO: 524928 - RNA, 32 nt, Human
uggcugucuugcaggacuggagaagguggugg

SEQ ID NO: 524929 - RNA, 32 nt, Human
uggcugucuuuaucauccccacaaacauuuug

SEQ ID NO: 524930 - RNA, 32 nt, Human
uggcugugaaaggacugaggcagccaucuggg

SEQ ID NO: 524931 - RNA, 32 nt, Human
uggcugugaacaaauaacaaauaagugcuccc

SEQ ID NO: 524932 - RNA, 32 nt, Human
uggcugugacccuacuuccugcacugacccac

SEQ ID NO: 524933 - RNA, 32 nt, Human
uggcugugaggggcugucccacugugugggua

SEQ ID NO: 524934 - RNA, 32 nt, Human
uggcugugagguuucuggggaggcagagaggc

SEQ ID NO: 524935 - RNA, 32 nt, Human
uggcugugaugaagugccagaaugucucuuua

SEQ ID NO: 524936 - RNA, 32 nt, Human
uggcugugcagcucccuccgugccucagaucu

SEQ ID NO: 524937 - RNA, 32 nt, Human
uggcugugcaggaggcugugguuugaaaacug

SEQ ID NO: 524938 - RNA, 19 nt, Human
uggcugugcucucugcaca

SEQ ID NO: 524939 - RNA, 32 nt, Human
uggcugugcugugguuucucccgacgugcaca

SEQ ID NO: 524940 - RNA, 32 nt, Human
uggcuguggcaucuacccucccguccccugcu

SEQ ID NO: 524941 - RNA, 32 nt, Human
uggcuguggcaucuacccucccucccugcugc

SEQ ID NO: 524942 - RNA, 32 nt, Human
uggcuguggccccagcaccugaggcaggggua

SEQ ID NO: 524943 - RNA, 29 nt, Human
uggcuguggcugcucagguuccccuccuc

SEQ ID NO: 524944 - RNA, 32 nt, Human
uggcugugggacagagguuggaaggaaaggac

SEQ ID NO: 524945 - RNA, 32 nt, Human
uggcugugggcugaggccucccagggaagcug

SEQ ID NO: 524946 - RNA, 32 nt, Human
uggcuguggguacauggggagggaccuuucac

SEQ ID NO: 524947 - RNA, 24 nt, Human
uggcugugguggcucacaccugua

SEQ ID NO: 524948 - RNA, 20 nt, Human
uggcuguguaugacgggagg

SEQ ID NO: 524949 - RNA, 32 nt, Human
uggcuguguuagacucucuccuuuuguguuuu

SEQ ID NO: 524950 - RNA, 32 nt, Human
uggcuguguuuggaagcuucagcccugcacau

SEQ ID NO: 524951 - RNA, 32 nt, Human
uggcuguuaaugauaucccuguucuaauucca

SEQ ID NO: 524952 - RNA, 24 nt, Human
uggcuguucaacuugagcauguua

SEQ ID NO: 524953 - RNA, 32 nt, Human
uggcuguucacacccgccucgcugucuuggag

SEQ ID NO: 524954 - RNA, 32 nt, Human
uggcuguucaugggaagucuucaguggccuuc

SEQ ID NO: 524955 - RNA, 32 nt, Human
uggcuguucccuggaggcugucccuuuaaagg

SEQ ID NO: 524956 - RNA, 32 nt, Human
uggcuguucuggguuuuugucauucacaguua

SEQ ID NO: 524957 - RNA, 32 nt, Human
uggcuguugcccgguguuucagcacuuucagu

SEQ ID NO: 524958 - RNA, 32 nt, Human
uggcuguugucucccaggcuggagugcagugg

SEQ ID NO: 524959 - RNA, 32 nt, Human
uggcuguuucccaggcugaagugcaguggcau

SEQ ID NO: 524960 - RNA, 32 nt, Human
uggcuuaaaagcaggauugaagaaaagggacu

SEQ ID NO: 524961 - RNA, 32 nt, Human
uggcuuaaaauggacuaaagguccuguucuug

SEQ ID NO: 524962 - RNA, 26 nt, Human
uggcuuaaagugauucuccugccuca

SEQ ID NO: 524963 - RNA, 32 nt, Human
uggcuuaaaucuccucuuuggaauucugcuga

SEQ ID NO: 524964 - RNA, 24 nt, Human
uggcuuaacuggaugccauaagac

SEQ ID NO: 524965 - RNA, 31 nt, Human
uggcuuaacuucucugggccuuuguuccuau

SEQ ID NO: 524966 - RNA, 20 nt, Human
uggcuuaagugauccuccca

SEQ ID NO: 524967 - RNA, 25 nt, Human
uggcuuaagugauccucccaccuca

SEQ ID NO: 524968 - RNA, 32 nt, Human
uggcuuaauggaucagagcagccccaggaggu

SEQ ID NO: 524969 - RNA, 32 nt, Human
uggcuuacaaacaacagaaacguauugcucac

SEQ ID NO: 524970 - RNA, 21 nt, Human
uggcuuacaccuauaauccca

SEQ ID NO: 524971 - RNA, 21 nt, Human
uggcuuacaccuguaagccca

SEQ ID NO: 524972 - RNA, 21 nt, Human
uggcuuacaccuguaauccca

SEQ ID NO: 524973 - RNA, 22 nt, Human
uggcuuacaccuguaaucccag

SEQ ID NO: 524974 - RNA, 23 nt, Human
uggcuuacaccuguaaucccagc

SEQ ID NO: 524975 - RNA, 32 nt, Human
uggcuuacaccuguaaucccagcacuuuggga

SEQ ID NO: 524976 - RNA, 24 nt, Human
uggcuuacaccuguaaucccagcu

SEQ ID NO: 524977 - RNA, 23 nt, Human
uggcuuacaccuguaaucccagu

SEQ ID NO: 524978 - RNA, 21 nt, Human
uggcuuacaccuguaauccua

SEQ ID NO: 524979 - RNA, 32 nt, Human
uggcuuacaccuguaauuccagcacuuuggga

SEQ ID NO: 524980 - RNA, 32 nt, Human
uggcuuacaccugugaucccagcacuuuggga

SEQ ID NO: 524981 - RNA, 21 nt, Human
uggcuuacaucuguaauccca

SEQ ID NO: 524982 - RNA, 23 nt, Human
uggcuuacaucuguaaucccagc

SEQ ID NO: 524983 - RNA, 32 nt, Human
uggcuuacauggugaaaccccaucucuacuaa

SEQ ID NO: 524984 - RNA, 21 nt, Human
uggcuuaccccuguaauccca

SEQ ID NO: 524985 - RNA, 23 nt, Human
uggcuuaccccuguaaucccagc

SEQ ID NO: 524986 - RNA, 21 nt, Human
uggcuuacgccuauaauccca

SEQ ID NO: 524987 - RNA, 32 nt, Human
uggcuuacgccuauaaucccagcacuuuggga

SEQ ID NO: 524988 - RNA, 21 nt, Human
uggcuuacgccuguaauccca

SEQ ID NO: 524989 - RNA, 23 nt, Human
uggcuuacgccuguaaucccagc

SEQ ID NO: 524990 - RNA, 32 nt, Human
uggcuuacgccuguaaucccagcacuuuggga

SEQ ID NO: 524991 - RNA, 32 nt, Human
uggcuuacgccuguaaucccagcgcuuuggga

SEQ ID NO: 524992 - RNA, 32 nt, Human
uggcuuacgccuguaaucccaggacuuuggga

SEQ ID NO: 524993 - RNA, 21 nt, Human
uggcuuacgccuguaauccua

SEQ ID NO: 524994 - RNA, 32 nt, Human
uggcuuacgccuguaauccuagcacuuuggga

SEQ ID NO: 524995 - RNA, 32 nt, Human
uggcuuacgccuguaauuccagcacuuuggga

SEQ ID NO: 524996 - RNA, 32 nt, Human
uggcuuacgcuuguagucccagcacuuuggga

SEQ ID NO: 524997 - RNA, 32 nt, Human
uggcuuacuacaaccuccgccuccuggguuca

SEQ ID NO: 524998 - RNA, 32 nt, Human
uggcuuacuccugagauaugauuugcaaauga

SEQ ID NO: 524999 - RNA, 32 nt, Human
uggcuuacugcaaccuccaccucccagguuca

SEQ ID NO: 525000 - RNA, 32 nt, Human
uggcuuacugcaaccuccaccuccuggguuca

SEQ ID NO: 525001 - RNA, 32 nt, Human
uggcuuacugcaaccuccgccucccagguuca

SEQ ID NO: 525002 - RNA, 32 nt, Human
uggcuuacugcaaccuccgccuccuggguuca

SEQ ID NO: 525003 - RNA, 32 nt, Human
uggcuuacugcaaccucugccucccagguuua

SEQ ID NO: 525004 - RNA, 32 nt, Human
uggcuuacugcaacuuccgacucccagguuca

SEQ ID NO: 525005 - RNA, 32 nt, Human
uggcuuacugcaagcucugccuccuggguuca

SEQ ID NO: 525006 - RNA, 32 nt, Human
uggcuuacugcagccuuugccuccccggcucg

SEQ ID NO: 525007 - RNA, 32 nt, Human
uggcuuacuguguuacuugccuaggaggaaug

SEQ ID NO: 525008 - RNA, 32 nt, Human
uggcuuacuuugucugccacagacacagacag

SEQ ID NO: 525009 - RNA, 18 nt, Human
uggcuuagcagaacccca

SEQ ID NO: 525010 - RNA, 32 nt, Human
uggcuuaggaaagaccaucauggccaugaaga

SEQ ID NO: 525011 - RNA, 19 nt, Human
uggcuuaggacucuccaca

SEQ ID NO: 525012 - RNA, 31 nt, Human
uggcuuagguuucagcgcccuucucaacccc

SEQ ID NO: 525013 - RNA, 21 nt, Human
uggcuuagugccacccaccuu

SEQ ID NO: 525014 - RNA, 32 nt, Human
uggcuuaucauggggaaaaagaggaucuggag

SEQ ID NO: 525015 - RNA, 32 nt, Human
uggcuuaugcccauaaucacagcacuucggga

SEQ ID NO: 525016 - RNA, 21 nt, Human
uggcuuaugccuauaauccua

SEQ ID NO: 525017 - RNA, 32 nt, Human
uggcuuaugccuauaauuccagcacuugggga

SEQ ID NO: 525018 - RNA, 21 nt, Human
uggcuuaugccuguaacccca

SEQ ID NO: 525019 - RNA, 23 nt, Human
uggcuuaugccuguaaccccagc

SEQ ID NO: 525020 - RNA, 18 nt, Human
uggcuuaugccuguaauc

SEQ ID NO: 525021 - RNA, 19 nt, Human
uggcuuaugccuguaaucc

SEQ ID NO: 525022 - RNA, 20 nt, Human
uggcuuaugccuguaauccc

SEQ ID NO: 525023 - RNA, 21 nt, Human
uggcuuaugccuguaauccca

SEQ ID NO: 525024 - RNA, 32 nt, Human
uggcuuaugccuguaaucccacuuugggaggc

SEQ ID NO: 525025 - RNA, 23 nt, Human
uggcuuaugccuguaaucccagc

SEQ ID NO: 525026 - RNA, 32 nt, Human
uggcuuaugccuguaaucccagcacucuggga

SEQ ID NO: 525027 - RNA, 32 nt, Human
uggcuuaugccuguaaucccagcacuugggga

SEQ ID NO: 525028 - RNA, 32 nt, Human
uggcuuaugccuguaaucccagcacuuugcag

SEQ ID NO: 525029 - RNA, 32 nt, Human
uggcuuaugccuguaaucccagcacuuuggaa

SEQ ID NO: 525030 - RNA, 32 nt, Human
uggcuuaugccuguaaucccagcacuuuggga

SEQ ID NO: 525031 - RNA, 32 nt, Human
uggcuuaugccuguaaucccagcacuuugggu

SEQ ID NO: 525032 - RNA, 32 nt, Human
uggggcaggagaaucacuugaaccugggaggc

SEQ ID NO: 525033 - RNA, 32 nt, Human
uggggcaggagaaucacuugagcccaggaguu

SEQ ID NO: 525034 - RNA, 32 nt, Human
uggggcaggaggaucacuugaggccaggaguu

SEQ ID NO: 525035 - RNA, 32 nt, Human
uggggcaggaggaucgcuugugcccagaaguu

SEQ ID NO: 525036 - RNA, 32 nt, Human
uggggcaggaggcagaggcaggagaccaagau

SEQ ID NO: 525037 - RNA, 32 nt, Human
uggggcaggccacacccccauuccgugccuca

SEQ ID NO: 525038 - RNA, 32 nt, Human
uggggcaggcggagguugcaguaagccaagau

SEQ ID NO: 525039 - RNA, 32 nt, Human
uggggcagggccuggcccuggacuggguuggc

SEQ ID NO: 525040 - RNA, 32 nt, Human
uggggcagggccugggccucauggcuuuugcu

SEQ ID NO: 525041 - RNA, 32 nt, Human
uggggcagguagaucacuugaggucaggagac

SEQ ID NO: 525042 - RNA, 32 nt, Human
uggggcaguaaaugagguuggcagaguggcag

SEQ ID NO: 525043 - RNA, 32 nt, Human
uggggcaguaucugguccugugccccagcugc

SEQ ID NO: 525044 - RNA, 19 nt, Human
uggggcagucgggguccuc

SEQ ID NO: 525045 - RNA, 19 nt, Human
uggggcagucuggguccuc

SEQ ID NO: 525046 - RNA, 32 nt, Human
uggggcaguguugacaggagugaggcauuuug

SEQ ID NO: 525047 - RNA, 32 nt, Human
uggggcauaaggacaggaaaagggacacauac

SEQ ID NO: 525048 - RNA, 24 nt, Human
uggggcaucccaagugggguccuc

SEQ ID NO: 525049 - RNA, 32 nt, Human
uggggcaugagcuggggauuuggggauggggg

SEQ ID NO: 525050 - RNA, 32 nt, Human
  misc_feature (24)..(24): n is a, c, g or u
  misc_feature (32)..(32): n is a, c, g or u
uggggcaugccuguaaucccagcnacucgccn

SEQ ID NO: 525051 - RNA, 32 nt, Human
uggggcaugccuguagucccaccuacuuggga

SEQ ID NO: 525052 - RNA, 32 nt, Human
uggggcaugccuguagucccacuuacuuggga

SEQ ID NO: 525053 - RNA, 32 nt, Human
uggggcaugccuguagucccagcuacucagaa

SEQ ID NO: 525054 - RNA, 32 nt, Human
uggggcaugggcucuaggggaaccuggggucg

SEQ ID NO: 525055 - RNA, 32 nt, Human
uggggccaacacagccaccaacucugggucca

SEQ ID NO: 525056 - RNA, 32 nt, Human
uggggccaagccccgagggccccugcaagcac

SEQ ID NO: 525057 - RNA, 32 nt, Human
uggggccaagugauccucccaccucagccucu

SEQ ID NO: 525058 - RNA, 32 nt, Human
uggggccaauuugugguuaagagguggugaga

SEQ ID NO: 525059 - RNA, 32 nt, Human
uggggccacaugcugacccagccccacaucca

SEQ ID NO: 525060 - RNA, 32 nt, Human
uggggccaccucaguccugccuggguccuggu

SEQ ID NO: 525061 - RNA, 32 nt, Human
uggggccaccuuccugucagugcccgagggac

SEQ ID NO: 525062 - RNA, 32 nt, Human
uggggccacugcacaggccaccugcuuggguu

SEQ ID NO: 525063 - RNA, 32 nt, Human
uggggccacugcacugcagccugugugacaaa

SEQ ID NO: 525064 - RNA, 32 nt, Human
uggggccagaccucuuuacacacacauucccg

SEQ ID NO: 525065 - RNA, 32 nt, Human
uggggccagaggccgccuuacacacaccccag

SEQ ID NO: 525066 - RNA, 32 nt, Human
uggggccagcaauacuccagagcccaguuucu

SEQ ID NO: 525067 - RNA, 32 nt, Human
uggggccagcccgcacacaccaugccuccugu

SEQ ID NO: 525068 - RNA, 20 nt, Human
uggggccaggaaggccccuc

SEQ ID NO: 525069 - RNA, 32 nt, Human
uggggccaggacgccagcugaggagggcagga

SEQ ID NO: 525070 - RNA, 32 nt, Human
uggggccaggagaggugggugccuugugaucu

SEQ ID NO: 525071 - RNA, 32 nt, Human
uggggccaggaggcagcagccgugcagagccu

SEQ ID NO: 525072 - RNA, 32 nt, Human
uggggccaggggccuggagacacuccauggag

SEQ ID NO: 525073 - RNA, 32 nt, Human
uggggccagggugggagggagggacaaggggg

SEQ ID NO: 525074 - RNA, 32 nt, Human
uggggccaggucucuucuccagccuccaccug

SEQ ID NO: 525075 - RNA, 32 nt, Human
uggggccaguaccaaggagaagcuuuuaccac

SEQ ID NO: 525076 - RNA, 19 nt, Human
uggggccaguggugccuca

SEQ ID NO: 525077 - RNA, 32 nt, Human
uggggccaugaagaaggcuggaagggacaggg

SEQ ID NO: 525078 - RNA, 32 nt, Human
uggggccauggacucggacgccagccuggugu

SEQ ID NO: 525079 - RNA, 32 nt, Human
uggggcccaaucucaaugcacauaucagugcg

SEQ ID NO: 525080 - RNA, 32 nt, Human
uggggcccacaaagucaaggcugcagugagcu

SEQ ID NO: 525081 - RNA, 18 nt, Human
uggggcccaccagccccu

SEQ ID NO: 525082 - RNA, 32 nt, Human
uggggcccagaacuucauaucaguuguauuau

SEQ ID NO: 525083 - RNA, 21 nt, Human
uggggcccagauugcagaugg

SEQ ID NO: 525084 - RNA, 32 nt, Human
uggggcccagcacggccaggcucucaccuuuu

SEQ ID NO: 525085 - RNA, 32 nt, Human
uggggcccagccaggcagggugugggggcagc

SEQ ID NO: 525086 - RNA, 32 nt, Human
uggggcccaggggaggccugagcuuggauuua

SEQ ID NO: 525087 - RNA, 32 nt, Human
uggggcccauguccaagacaauuccuggcaua

SEQ ID NO: 525088 - RNA, 18 nt, Human
uggggccccacagcccuc

SEQ ID NO: 525089 - RNA, 32 nt, Human
uggggccccaggaggaccucgggcugugggcc

SEQ ID NO: 525090 - RNA, 22 nt, Human
uggggcccccugccagccccuu

SEQ ID NO: 525091 - RNA, 32 nt, Human
uggggccccuguccuccagccugaccagcccu

SEQ ID NO: 525092 - RNA, 32 nt, Human
uggggccccuuggugaaccugaugcagguaag

SEQ ID NO: 525093 - RNA, 32 nt, Human
uggggcccggugucacucacagcuccaucucu

SEQ ID NO: 525094 - RNA, 32 nt, Human
uggggcccgucaucuugcacccuggcucugca

SEQ ID NO: 525095 - RNA, 25 nt, Human
uggggcccguuucuggccagagggu

SEQ ID NO: 525096 - RNA, 18 nt, Human
uggggcccucagccccuu

SEQ ID NO: 525097 - RNA, 32 nt, Human
uggggcccuccccugccgcauucccucacugg

SEQ ID NO: 525098 - RNA, 19 nt, Human
uggggcccugcccaagugg

SEQ ID NO: 525099 - RNA, 32 nt, Human
uggggcccugcugucaaccucuccuccaggcc

SEQ ID NO: 525100 - RNA, 21 nt, Human
uggggcccuuggccccagagg

SEQ ID NO: 525101 - RNA, 32 nt, Human
uggggccgcaugguacuuacaguuguucacuu

SEQ ID NO: 525102 - RNA, 32 nt, Human
uggggccgccgucuuccguccuaggagacucc

SEQ ID NO: 525103 - RNA, 32 nt, Human
uggggccggaggcggggugugagugggugugu

SEQ ID NO: 525104 - RNA, 19 nt, Human
uggggccggcugggcccuc

SEQ ID NO: 525105 - RNA, 32 nt, Human
uggggccggcuugcuucaugggcuagagccgc

SEQ ID NO: 525106 - RNA, 32 nt, Human
uggggccgggcaccggucacacggccaccgcc

SEQ ID NO: 525107 - RNA, 32 nt, Human
uggggccucaccugcuggaguccuuuguggcc

SEQ ID NO: 525108 - RNA, 32 nt, Human
uggggccucaccugcuggagucuucgguggcc

SEQ ID NO: 525109 - RNA, 32 nt, Human
uggggccucaccugcuggagucuuugguggcc

SEQ ID NO: 525110 - RNA, 32 nt, Human
uggggccuccuuguccuggauuuccagcucuc

SEQ ID NO: 525111 - RNA, 32 nt, Human
uggggccucugccucucgucugaccuugcagc

SEQ ID NO: 525112 - RNA, 32 nt, Human
uggggccucugggguggagcagcuuccgauag

SEQ ID NO: 525113 - RNA, 32 nt, Human
uggggccugaagggaaaugaggcagcugcugu

SEQ ID NO: 525114 - RNA, 32 nt, Human
uggggccugaagggaaaugggcagcugcugug

SEQ ID NO: 525115 - RNA, 32 nt, Human
uggggccugagcugccccacacaggaugcccc

SEQ ID NO: 525116 - RNA, 32 nt, Human
uggggccugaggcuucacaguaccuggaccag

SEQ ID NO: 525117 - RNA, 32 nt, Human
uggggccugcagccacuggcauugccaagaac

SEQ ID NO: 525118 - RNA, 32 nt, Human
uggggccugcaggcgcccuuguggaguuacca

SEQ ID NO: 525119 - RNA, 32 nt, Human
uggggccugcauaagaaaacuuaucucauuau

SEQ ID NO: 525120 - RNA, 32 nt, Human
uggggccugccggguguuccugggaagauggg

SEQ ID NO: 525121 - RNA, 23 nt, Human
uggggccugcucagccaagaagg

SEQ ID NO: 525122 - RNA, 32 nt, Human
uggggccugcucccagccacugaggcccgcuc

SEQ ID NO: 525123 - RNA, 32 nt, Human
uggggccuggccaggacucccagugugccaga

SEQ ID NO: 525124 - RNA, 32 nt, Human
uggggccuggccaggccaggguuugggccuaa

SEQ ID NO: 525125 - RNA, 32 nt, Human
uggggccugggcucccccucucugugccagcg

SEQ ID NO: 525126 - RNA, 32 nt, Human
uggggccugggugggcaggcaggaccugggcc

SEQ ID NO: 525127 - RNA, 32 nt, Human
uggggccuucacaggcugcagugggucccgag

SEQ ID NO: 525128 - RNA, 32 nt, Human
uggggccuuccucuuuguuucuuggguccuaa

SEQ ID NO: 525129 - RNA, 32 nt, Human
uggggccuugcuccucuuccuccuuucuuggc

SEQ ID NO: 525130 - RNA, 32 nt, Human
uggggccuuggcucuugggccugcugccucuu

SEQ ID NO: 525131 - RNA, 32 nt, Human
uggggccuuguuccccagaggguccccaggga

SEQ ID NO: 525132 - RNA, 32 nt, Human
uggggcgaggcagaggacagaucaauggcgca

SEQ ID NO: 525133 - RNA, 32 nt, Human
uggggcgcaccacggucacuuuggccuggaaa

SEQ ID NO: 525134 - RNA, 32 nt, Human
uggggcgcaggagggagaaguugcuaagugcu

SEQ ID NO: 525135 - RNA, 32 nt, Human
uggggcgcagugaggcugggagccggcccuga

SEQ ID NO: 525136 - RNA, 32 nt, Human
uggggcgcaguggcucacgccuguaaucccag

SEQ ID NO: 525137 - RNA, 32 nt, Human
uggggcgcauuccaaccuuccagccugcgacc

SEQ ID NO: 525138 - RNA, 32 nt, Human
uggggcgccugccucccugcuccucuguccuc

SEQ ID NO: 525139 - RNA, 32 nt, Human
uggggcgcgggugggagcgcgggggaacccuc

SEQ ID NO: 525140 - RNA, 32 nt, Human
uggggcggacugaacagagggagcuccagcuc

SEQ ID NO: 525141 - RNA, 32 nt, Human
uggggcggaggcagcggcuguagcggggcugu

SEQ ID NO: 525142 - RNA, 32 nt, Human
uggggcggaggguggaaggcagcuuccgucga

SEQ ID NO: 525143 - RNA, 32 nt, Human
uggggcggagucucacuguguugcccaggcug

SEQ ID NO: 525144 - RNA, 32 nt, Human
uggggcggccaguuuugacacgccccagugcc

SEQ ID NO: 525145 - RNA, 32 nt, Human
uggggcggcccaggcugaagccaucuccgggu

SEQ ID NO: 525146 - RNA, 32 nt, Human
uggggcggcgaauuugggaaggagggagaggg

SEQ ID NO: 525147 - RNA, 32 nt, Human
uggggcggcgccgccucuccacccgcagccug

SEQ ID NO: 525148 - RNA, 32 nt, Human
uggggcggcugaaguaggagggucacuuagcc

SEQ ID NO: 525149 - RNA, 32 nt, Human
uggggcgggacuuccggcauuuggaugggacg

SEQ ID NO: 525150 - RNA, 31 nt, Human
uggggcgggaugcuugggccugggucucucc

SEQ ID NO: 525151 - RNA, 32 nt, Human
uggggcgggcaacccccagaaagcgggcagca

SEQ ID NO: 525152 - RNA, 32 nt, Human
uggggcgggcugaugagcaccuggauuuucac

SEQ ID NO: 525153 - RNA, 32 nt, Human
uggggcggggcuuggaaggagcagggagccuu

SEQ ID NO: 525154 - RNA, 32 nt, Human
uggggcgguaacuccaugcccgcgggcacagg

SEQ ID NO: 525155 - RNA, 32 nt, Human
uggggcggugugugugccaugucacagcaugg

SEQ ID NO: 525156 - RNA, 32 nt, Human
uggggcgucccucccgcucgcuucuugacucg

SEQ ID NO: 525157 - RNA, 32 nt, Human
uggggcgugaagaacagaagacaggaagcguu

SEQ ID NO: 525158 - RNA, 32 nt, Human
uggggcgugaagaacagaagacaggagaaaag

SEQ ID NO: 525159 - RNA, 32 nt, Human
uggggcgugagagcggggguuagguggcaccc

SEQ ID NO: 525160 - RNA, 32 nt, Human
uggggcgugccuguagucccauguacuuggga

SEQ ID NO: 525161 - RNA, 32 nt, Human
uggggcgugcuucaggcuccucccucuaaggg

SEQ ID NO: 525162 - RNA, 32 nt, Human
uggggcguggggcuggggcagagcaggguucc

SEQ ID NO: 525163 - RNA, 19 nt, Human
uggggcgugggggguuaga

SEQ ID NO: 525164 - RNA, 32 nt, Human
uggggcguggugaguuggaaugauacguccau

SEQ ID NO: 525165 - RNA, 32 nt, Human
uggggcguuugggggugugcgguggggaggug

SEQ ID NO: 525166 - RNA, 19 nt, Human
uggggcuaagcagcccccu

SEQ ID NO: 525167 - RNA, 32 nt, Human
uggggcuaagcagcugucgcacggucagauca

SEQ ID NO: 525168 - RNA, 32 nt, Human
uggggcuaaggcaggaggaucacuugagcccc

SEQ ID NO: 525169 - RNA, 32 nt, Human
uggggcuaagugagagauggauacacuguuuc

SEQ ID NO: 525170 - RNA, 32 nt, Human
uggggcuagggggagccccuucugcucagcuc

SEQ ID NO: 525171 - RNA, 32 nt, Human
uggggcuauaggagccucccacuuucaccaga

SEQ ID NO: 525172 - RNA, 19 nt, Human
uggggcucaagaagccugg

SEQ ID NO: 525173 - RNA, 32 nt, Human
uggggcucaagcaguucucccaccagccuccu

SEQ ID NO: 525174 - RNA, 32 nt, Human
uggggcucacagucuggcugcaccggcucacc

SEQ ID NO: 525175 - RNA, 32 nt, Human
uggggcucacauucuagacugggaaacauaca

SEQ ID NO: 525176 - RNA, 20 nt, Human
uggggcucagcuggagucag

SEQ ID NO: 525177 - RNA, 19 nt, Human
uggggcucagcuucccucu

SEQ ID NO: 525178 - RNA, 21 nt, Human
uggggcucagggcagccaccc

SEQ ID NO: 525179 - RNA, 32 nt, Human
uggggcucaugagggaggauggaguuucuugg

SEQ ID NO: 525180 - RNA, 32 nt, Human
uggggcuccagaaccucccaaguuauguucuc

SEQ ID NO: 525181 - RNA, 32 nt, Human
uggggcuccaggaccuucccuaccuccaccac

SEQ ID NO: 525182 - RNA, 32 nt, Human
uggggcuccaucuaggcucugaaaggauauuc

SEQ ID NO: 525183 - RNA, 18 nt, Human
uggggcucccaauccccu

SEQ ID NO: 525184 - RNA, 32 nt, Human
uggggcucccacaggcuggagugcaauggugu

SEQ ID NO: 525185 - RNA, 32 nt, Human
uggggcucccagaggagcucucggcucuaagu

SEQ ID NO: 525186 - RNA, 32 nt, Human
uggggcucccuaggccucucccucuucagagg

SEQ ID NO: 525187 - RNA, 32 nt, Human
uggggcuccgaacccuaaaugggugagaguug

SEQ ID NO: 525188 - RNA, 32 nt, Human
uggggcuccgguuucaggggugagaggagcca

SEQ ID NO: 525189 - RNA, 21 nt, Human
uggggcuccuccagcuccccc

SEQ ID NO: 525190 - RNA, 32 nt, Human
uggggcuccuggaaggaggaagaggcucucca

SEQ ID NO: 525191 - RNA, 32 nt, Human
uggggcucucagaacuuaagagaugugccauc

SEQ ID NO: 525192 - RNA, 32 nt, Human
uggggcucucauucugacagcuccuuaaaugc

SEQ ID NO: 525193 - RNA, 18 nt, Human
uggggcucuccacccccu

SEQ ID NO: 525194 - RNA, 32 nt, Human
uggggcucugcaguuccugcaucucuaagcuu

SEQ ID NO: 525195 - RNA, 32 nt, Human
uggggcucuggcugccuucuccacccacccca

SEQ ID NO: 525196 - RNA, 32 nt, Human
uggggcucugggaggaagaagcgucaggacug

SEQ ID NO: 525197 - RNA, 32 nt, Human
uggggcucuuacucccuccugaggccagcugc

SEQ ID NO: 525198 - RNA, 32 nt, Human
uggggcucuugggcagaaagaugaggagacag

SEQ ID NO: 525199 - RNA, 32 nt, Human
uggggcucuugguuuccagagggucuggacug

SEQ ID NO: 525200 - RNA, 32 nt, Human
uggggcucuuucucugaaggccacuuuccuga

SEQ ID NO: 525201 - RNA, 32 nt, Human
uggggcugaaagcagaagcaugcacagggagg

SEQ ID NO: 525202 - RNA, 32 nt, Human
uggggcugaaggagcuauaauacaaacagggg

SEQ ID NO: 525203 - RNA, 32 nt, Human
uggggcugagaacugcagcccugggucuuccc

SEQ ID NO: 525204 - RNA, 32 nt, Human
uggggcugagacugggcugacaucuagaauca

SEQ ID NO: 525205 - RNA, 32 nt, Human
uggggcugaggcugaggcacuggcgaggagag

SEQ ID NO: 525206 - RNA, 32 nt, Human
uggggcugaggggcugcaaggagaaguugcau

SEQ ID NO: 525207 - RNA, 32 nt, Human
uggggcugagguugggggaggggugggcggca

SEQ ID NO: 525208 - RNA, 32 nt, Human
uggggcugagucuucacuuuguuuugcugugg

SEQ ID NO: 525209 - RNA, 32 nt, Human
uggggcugagugaaaacaucugcacaacuggg

SEQ ID NO: 525210 - RNA, 32 nt, Human
uggggcugcaccacccggcccgaggcuuuuga

SEQ ID NO: 525211 - RNA, 32 nt, Human
uggggcugcaggaagccaucggugagaaggcc

SEQ ID NO: 525212 - RNA, 32 nt, Human
uggggcugcccaggcaaagucagugaacauga

SEQ ID NO: 525213 - RNA, 32 nt, Human
uggggcugccugaggaugaggcugcaucuccc

SEQ ID NO: 525214 - RNA, 32 nt, Human
uggggcugcggcucuggccucccaggcccauc

SEQ ID NO: 525215 - RNA, 32 nt, Human
uggggcugcucugggcccuggaauccaagaaa

SEQ ID NO: 525216 - RNA, 32 nt, Human
uggggcugcugggugcacagaugaggggaggu

SEQ ID NO: 525217 - RNA, 32 nt, Human
uggggcugcuugugguuuccaaacgucggcag

SEQ ID NO: 525218 - RNA, 32 nt, Human
uggggcuggaaccugggguuuugcuugggugu

SEQ ID NO: 525219 - RNA, 32 nt, Human
uggggcuggaccaggcccuggaggccaauaaa

SEQ ID NO: 525220 - RNA, 32 nt, Human
uggggcuggagagagaggaccaucccaggcug

SEQ ID NO: 525221 - RNA, 32 nt, Human
uggggcuggaugcuuggguaacuggggcaggg

SEQ ID NO: 525222 - RNA, 22 nt, Human
uggggcuggcaagaggccgcug

SEQ ID NO: 525223 - RNA, 32 nt, Human
uggggcuggcugcugcggcggcggcgcugggc

SEQ ID NO: 525224 - RNA, 32 nt, Human
uggggcugggcauggaggcucacaccuguaau

SEQ ID NO: 525225 - RNA, 32 nt, Human
uggggcugggcugagccagggaggaaggaccc

SEQ ID NO: 525226 - RNA, 32 nt, Human
uggggcugggcuggagaggguggcaggcagug

SEQ ID NO: 525227 - RNA, 32 nt, Human
uggggcugggguccccucagugugaauggccc

SEQ ID NO: 525228 - RNA, 32 nt, Human
uggggcugggguguuuaccuggagccuggaca

SEQ ID NO: 525229 - RNA, 22 nt, Human
uggggcuggguccccuagugga

SEQ ID NO: 525230 - RNA, 32 nt, Human
uggggcuggguucugucuucuacaggccaccc

SEQ ID NO: 525231 - RNA, 19 nt, Human
uggggcuguacagggcccu

SEQ ID NO: 525232 - RNA, 32 nt, Human
uggggcugucaacgcugccccuuguccugccg

SEQ ID NO: 525233 - RNA, 32 nt, Human
uggggcuguccauccauggcucugccuacgga

SEQ ID NO: 525234 - RNA, 29 nt, Human
uggggcugucuguguuucccagguggagc

SEQ ID NO: 525235 - RNA, 32 nt, Human
uggggcugugaauucuuucuucauccccgcau

SEQ ID NO: 525236 - RNA, 32 nt, Human
uggggcugugcaccuuccugguguuuggacag

SEQ ID NO: 525237 - RNA, 32 nt, Human
uggggcugugccgcccacaggaguugagacaa

SEQ ID NO: 525238 - RNA, 32 nt, Human
uggggcuguggccucucagggggcagccucuc

SEQ ID NO: 525239 - RNA, 32 nt, Human
uggggcugugggcucagagcucaggagucgcc

SEQ ID NO: 525240 - RNA, 32 nt, Human
uggggcuguggugcuagggcuguggggcacag

SEQ ID NO: 525241 - RNA, 32 nt, Human
uggggcuguuccugugaacagagcagaguggg

SEQ ID NO: 525242 - RNA, 32 nt, Human
uggggcuguuucuccccuccgacuggggcucc

SEQ ID NO: 525243 - RNA, 32 nt, Human
uggggcuucaggaguaauaaagugucacccua

SEQ ID NO: 525244 - RNA, 21 nt, Human
uggggcuuccggcccuacaca

SEQ ID NO: 525245 - RNA, 32 nt, Human
uggggcuuccuugagaaggccagccccaaagg

SEQ ID NO: 525246 - RNA, 32 nt, Human
uggggcuucucccucccguuucaggggaaagg

SEQ ID NO: 525247 - RNA, 32 nt, Human
uggggcuucucuucccuccaugagccuggaga

SEQ ID NO: 525248 - RNA, 32 nt, Human
uggggcuucuucuccccuucuuccuuuccccu

SEQ ID NO: 525249 - RNA, 32 nt, Human
uggggcuugcuaacuguugagcuguuuuaacu

SEQ ID NO: 525250 - RNA, 32 nt, Human
uggggcuuggggcgugcgagauuucccuugca

SEQ ID NO: 525251 - RNA, 32 nt, Human
uggggcuugggggcgggggaggguggcagugg

SEQ ID NO: 525252 - RNA, 32 nt, Human
uggggcuugugcagcuggcaguguuccugccc

SEQ ID NO: 525253 - RNA, 32 nt, Human
uggggcuuucaacccucucccccaccacccag

SEQ ID NO: 525254 - RNA, 32 nt, Human
uggggcuuugggcugggaggggaaggcggguc

SEQ ID NO: 525255 - RNA, 19 nt, Human
uggggcuuuuagagccccc

SEQ ID NO: 525256 - RNA, 32 nt, Human
uggggcuuuucuuccuccccugcucucucucc

SEQ ID NO: 525257 - RNA, 32 nt, Human
ugggggaaaaagcagcaggauccagagcuaua

SEQ ID NO: 525258 - RNA, 32 nt, Human
ugggggaaacaggcgguuccugcccgguucuu

SEQ ID NO: 525259 - RNA, 32 nt, Human
ugggggaaaccagcuucuugccagccacagcu

SEQ ID NO: 525260 - RNA, 18 nt, Human
ugggggaaacccaguggg

SEQ ID NO: 525261 - RNA, 32 nt, Human
ugggggaaacugaggcaguggggaagacagag

SEQ ID NO: 525262 - RNA, 32 nt, Human
ugggggaaagagcauccggagugaaggggacg

SEQ ID NO: 525263 - RNA, 32 nt, Human
ugggggaaggagagaagggcagcucagggugg

SEQ ID NO: 525264 - RNA, 32 nt, Human
ugggggaagggcagggguguggagagggggug

SEQ ID NO: 525265 - RNA, 32 nt, Human
ugggggaagggccacaaccucuguuucuguga

SEQ ID NO: 525266 - RNA, 32 nt, Human
ugggggaagggugaguuuacaggugaggagug

SEQ ID NO: 525267 - RNA, 32 nt, Human
ugggggaaguggccagaguagagaugcuggga

SEQ ID NO: 525268 - RNA, 32 nt, Human
ugggggaauaagaguaggcucaguugacagaa

SEQ ID NO: 525269 - RNA, 32 nt, Human
ugggggaaucgucaugacugccaaucucaaca

SEQ ID NO: 525270 - RNA, 32 nt, Human
ugggggaaucuugccuuucccuuucagagccc

SEQ ID NO: 525271 - RNA, 32 nt, Human
ugggggacaacaaaacauguuuuccuuuuucu

SEQ ID NO: 525272 - RNA, 32 nt, Human
ugggggacaauguacagcauucuggccaucca

SEQ ID NO: 525273 - RNA, 32 nt, Human
ugggggacacgccuggugucucuuacuccgac

SEQ ID NO: 525274 - RNA, 32 nt, Human
ugggggacacuuccagugugcaugccagagug

SEQ ID NO: 525275 - RNA, 32 nt, Human
ugggggacagcgucccagccccgagggcaagc

SEQ ID NO: 525276 - RNA, 24 nt, Human
ugggggacagggcagggcuggguc

SEQ ID NO: 525277 - RNA, 32 nt, Human
ugggggacgccgcccucucugccgcaggcugg

SEQ ID NO: 525278 - RNA, 32 nt, Human
ugggggacggccgccuccucccagccacugug

SEQ ID NO: 525279 - RNA, 32 nt, Human
ugggggacugcuuucagugccugcuguucgug

SEQ ID NO: 525280 - RNA, 20 nt, Human
ugggggacugggaggccugg

SEQ ID NO: 525281 - RNA, 32 nt, Human
ugggggacugggugggaaggguggugggagga

SEQ ID NO: 525282 - RNA, 32 nt, Human
ugggggacuuccugccuguccccauggccugu

SEQ ID NO: 525283 - RNA, 32 nt, Human
ugggggacuugcagccaggagugaucugcuga

SEQ ID NO: 525284 - RNA, 32 nt, Human
ugggggagaaaaagagccccuccucuggggua

SEQ ID NO: 525285 - RNA, 32 nt, Human
ugggggagaaaagggaaaaugcugucaguaga

SEQ ID NO: 525286 - RNA, 32 nt, Human
ugggggagaacagcauucccgccgccuccagc

SEQ ID NO: 525287 - RNA, 32 nt, Human
ugggggagacuaagggcuacaggccagcgugg

SEQ ID NO: 525288 - RNA, 32 nt, Human
ugggggagagaagggaaaagauccccaagacc

SEQ ID NO: 525289 - RNA, 32 nt, Human
ugggggagagguacagaaagaagagaaaagac

SEQ ID NO: 525290 - RNA, 32 nt, Human
ugggggagagguuaggaggagagaggacgaag

SEQ ID NO: 525291 - RNA, 32 nt, Human
ugggggagcccugcccuccugguucggccucc

SEQ ID NO: 525292 - RNA, 18 nt, Human
ugggggagccgggcccuc

SEQ ID NO: 525293 - RNA, 32 nt, Human
ugggggaggaagagagggaggcacguaggaac

SEQ ID NO: 525294 - RNA, 21 nt, Human
ugggggaggacacgguccccc

SEQ ID NO: 525295 - RNA, 32 nt, Human
ugggggaggagaaagaggggucacuccugcca

SEQ ID NO: 525296 - RNA, 32 nt, Human
ugggggaggagagagauaacaaacuggugagc

SEQ ID NO: 525297 - RNA, 18 nt, Human
ugggggaggagaugggga

SEQ ID NO: 525298 - RNA, 32 nt, Human
ugggggaggagguugagggaacagggggcuga

SEQ ID NO: 525299 - RNA, 32 nt, Human
ugggggaggaguucuuuucucagucucgcccc

SEQ ID NO: 525300 - RNA, 32 nt, Human
ugggggaggccggaucucuagagccauccugc

SEQ ID NO: 525301 - RNA, 32 nt, Human
ugggggaggcugggagagguugggugcucucc

SEQ ID NO: 525302 - RNA, 32 nt, Human
ugggggaggcugucccacucccagcucuggca

SEQ ID NO: 525303 - RNA, 32 nt, Human
ugggggaggcuuccagcucagucccacagccc

SEQ ID NO: 525304 - RNA, 32 nt, Human
ugggggagggacugcugacccaccaaggucuc

SEQ ID NO: 525305 - RNA, 32 nt, Human
ugggggagggagggaaagagaagagcucugca

SEQ ID NO: 525306 - RNA, 32 nt, Human
ugggggaggggaggggcaggaagaggugagaa

SEQ ID NO: 525307 - RNA, 32 nt, Human
ugggggaggguaacugauggcaagggugggaa

SEQ ID NO: 525308 - RNA, 32 nt, Human
ugggggaguccacccucuccuugaugcagcuu

SEQ ID NO: 525309 - RNA, 32 nt, Human
ugggggagucuggagagagacuggacagggua

SEQ ID NO: 525310 - RNA, 32 nt, Human
ugggggauaagaaagccugggaggggccugug

SEQ ID NO: 525311 - RNA, 32 nt, Human
ugggggaucagcagggcaguugucgggcaguc

SEQ ID NO: 525312 - RNA, 32 nt, Human
ugggggaucagugccugcugugugcugauacu

SEQ ID NO: 525313 - RNA, 32 nt, Human
ugggggaugacgguggggagguugccagaugu

SEQ ID NO: 525314 - RNA, 32 nt, Human
ugggggaugaggucagggggucuuggguggga

SEQ ID NO: 525315 - RNA, 32 nt, Human
ugggggaugccaugagggccucccaccacaaa

SEQ ID NO: 525316 - RNA, 32 nt, Human
ugggggauggagcagggaauaagacauugaaa

SEQ ID NO: 525317 - RNA, 32 nt, Human
ugggggaugggaggguuggauugaacagccag

SEQ ID NO: 525318 - RNA, 22 nt, Human
ugggggauggggauggggccag

SEQ ID NO: 525319 - RNA, 32 nt, Human
ugggggauggggauggggccaggcucagugua

SEQ ID NO: 525320 - RNA, 32 nt, Human
ugggggauuccugggagccaugugggagaggc

SEQ ID NO: 525321 - RNA, 32 nt, Human
ugggggcaaaucaggacacaacagagggcaga

SEQ ID NO: 525322 - RNA, 32 nt, Human
ugggggcacaacuguuuucuguuugcuguuuu

SEQ ID NO: 525323 - RNA, 32 nt, Human
ugggggcacaggcugaauuagaugagcuccug

SEQ ID NO: 525324 - RNA, 23 nt, Human
ugggggcaccaagaccccaaagg

SEQ ID NO: 525325 - RNA, 32 nt, Human
ugggggcaccaucaaggacagaacagcaauuu

SEQ ID NO: 525326 - RNA, 19 nt, Human
ugggggcaccucuggccuc

SEQ ID NO: 525327 - RNA, 32 nt, Human
ugggggcaccuuaagauuuugcaccuguaaag

SEQ ID NO: 525328 - RNA, 32 nt, Human
ugggggcacgaagugggcccugggugaccccc

SEQ ID NO: 525329 - RNA, 32 nt, Human
ugggggcacugaggaccagccauugaggggug

SEQ ID NO: 525330 - RNA, 32 nt, Human
ugggggcagaguccuaggaugaggcuugggca

SEQ ID NO: 525331 - RNA, 32 nt, Human
ugggggcagauauuauccccauuuuucagaug

SEQ ID NO: 525332 - RNA, 32 nt, Human
ugggggcagcccuuaaaucccuucccuguggg

SEQ ID NO: 525333 - RNA, 32 nt, Human
ugggggcagcgagcuccagcccucggcggugg

SEQ ID NO: 525334 - RNA, 20 nt, Human
ugggggcagcucccagcgag

SEQ ID NO: 525335 - RNA, 32 nt, Human
ugggggcagcucucuucucuccccaggaccca

SEQ ID NO: 525336 - RNA, 32 nt, Human
ugggggcagcugugccaaucuaccucacaggc

SEQ ID NO: 525337 - RNA, 32 nt, Human
ugggggcaggaaaggugagguguugcuggccu

SEQ ID NO: 525338 - RNA, 32 nt, Human
ugggggcaggcagaagggagaaccagcucaag

SEQ ID NO: 525339 - RNA, 32 nt, Human
ugggggcagggagccuggccaggccugagaca

SEQ ID NO: 525340 - RNA, 32 nt, Human
ugggggcagggaggggacagugugggccuggc

SEQ ID NO: 525341 - RNA, 32 nt, Human
ugggggcaggguggaguggagggggagcuacu

SEQ ID NO: 525342 - RNA, 32 nt, Human
ugggggcagggugggggcacgaagugggcccu

SEQ ID NO: 525343 - RNA, 32 nt, Human
ugggggcaggguggggguugauguugaacuuu

SEQ ID NO: 525344 - RNA, 32 nt, Human
ugggggcagguguggggcuguggaauuccaaa

SEQ ID NO: 525345 - RNA, 32 nt, Human
ugggggcaguccugugcacggccuccaugaaa

SEQ ID NO: 525346 - RNA, 32 nt, Human
ugggggcagugggggaaggaaggggagaggug

SEQ ID NO: 525347 - RNA, 20 nt, Human
ugggggcaugccgggcccuc

SEQ ID NO: 525348 - RNA, 32 nt, Human
ugggggccacagccacaccucaccgcccaguc

SEQ ID NO: 525349 - RNA, 32 nt, Human
ugggggccacagggacacugcucugccugccu

SEQ ID NO: 525350 - RNA, 24 nt, Human
ugggggccacagggucccagcaga

SEQ ID NO: 525351 - RNA, 32 nt, Human
ugggggccaccaggcucagcgcaagaggaagc

SEQ ID NO: 525352 - RNA, 32 nt, Human
ugggggccaccccacugggggucuccaguggu

SEQ ID NO: 525353 - RNA, 32 nt, Human
ugggggccagaagacaagagagacggcgaggc

SEQ ID NO: 525354 - RNA, 32 nt, Human
ugggggccagcccuggauagguuuuuauggga

SEQ ID NO: 525355 - RNA, 32 nt, Human
ugggggccaggccacauggcuggagaggaauu

SEQ ID NO: 525356 - RNA, 24 nt, Human
ugggggccauggcucaugccugua

SEQ ID NO: 525357 - RNA, 32 nt, Human
ugggggccauucugagccugcagugagaguuu

SEQ ID NO: 525358 - RNA, 32 nt, Human
ugggggccauuuucucuacaggcaaauggaau

SEQ ID NO: 525359 - RNA, 21 nt, Human
ugggggcccacugccuaggga

SEQ ID NO: 525360 - RNA, 32 nt, Human
ugggggcccacuguggagagcugguuucccac

SEQ ID NO: 525361 - RNA, 22 nt, Human
ugggggcccaucgccgugggga

SEQ ID NO: 525362 - RNA, 18 nt, Human
ugggggcccauggggccc

SEQ ID NO: 525363 - RNA, 32 nt, Human
ugggggcccauggggcccccaagaagcggacu

SEQ ID NO: 525364 - RNA, 32 nt, Human
ugggggcccugugcccuugccggcggcagguu

SEQ ID NO: 525365 - RNA, 32 nt, Human
ugggggccgaacagcagugcucaccagugacg

SEQ ID NO: 525366 - RNA, 32 nt, Human
ugggggccgguggcucaccccuguaaucucag

SEQ ID NO: 525367 - RNA, 32 nt, Human
ugggggccgucagcugucuccuugauguuugg

SEQ ID NO: 525368 - RNA, 32 nt, Human
ugggggccuaaacuuguuccugccucccucac

SEQ ID NO: 525369 - RNA, 32 nt, Human
ugggggccucaaggaauccgggugugcugaga

SEQ ID NO: 525370 - RNA, 32 nt, Human
ugggggccugagagacagacaggaacccacaa

SEQ ID NO: 525371 - RNA, 32 nt, Human
ugggggccugagcagacacagaggugcaggca

SEQ ID NO: 525372 - RNA, 32 nt, Human
ugggggccuugagugaaaggcagcagugggag

SEQ ID NO: 525373 - RNA, 32 nt, Human
ugggggccuugcagccuccaccccuacagugc

SEQ ID NO: 525374 - RNA, 32 nt, Human
ugggggccuuucuuuaacugccuuccuggcuu

SEQ ID NO: 525375 - RNA, 32 nt, Human
ugggggcgaaaggagagagggagggaagggug

SEQ ID NO: 525376 - RNA, 32 nt, Human
ugggggcgagcuuccugcagcugcagagcauc

SEQ ID NO: 525377 - RNA, 32 nt, Human
ugggggcgcaaacccuuuuccucccagccuau

SEQ ID NO: 525378 - RNA, 32 nt, Human
ugggggcgcagcccuguggugcucaggcagag

SEQ ID NO: 525379 - RNA, 32 nt, Human
ugggggcgcggugcugccgccuccaggucucc

SEQ ID NO: 525380 - RNA, 32 nt, Human
ugggggcggaggcgggagugagaggagaaggg

SEQ ID NO: 525381 - RNA, 32 nt, Human
ugggggcggagggagcuggagcugucacaguc

SEQ ID NO: 525382 - RNA, 32 nt, Human
ugggggcggaugguggcccaggagacagcaca

SEQ ID NO: 525383 - RNA, 32 nt, Human
ugggggcggcugccugugucagccagggagcu

SEQ ID NO: 525384 - RNA, 32 nt, Human
ugggggcggggagguggaguggagaggcccgc

SEQ ID NO: 525385 - RNA, 32 nt, Human
ugggggcggggcaggggcagguguagccucug

SEQ ID NO: 525386 - RNA, 20 nt, Human
ugggggcggggccgggggga

SEQ ID NO: 525387 - RNA, 22 nt, Human
ugggggcggggguccaggcaga

SEQ ID NO: 525388 - RNA, 24 nt, Human
ugggggcgguagcucauaccugua

SEQ ID NO: 525389 - RNA, 32 nt, Human
ugggggcgucagcagaggggcagagauaauga

SEQ ID NO: 525390 - RNA, 32 nt, Human
ugggggcguugagggccaucucacaggcugcc

SEQ ID NO: 525391 - RNA, 22 nt, Human
ugggggcuaagguuuccaguca

SEQ ID NO: 525392 - RNA, 32 nt, Human
ugggggcucaggagacagaagggacagugggc

SEQ ID NO: 525393 - RNA, 32 nt, Human
ugggggcucccagggucuccgguggugcaccu

SEQ ID NO: 525394 - RNA, 32 nt, Human
ugggggcuccugcccuccuccaacaacccagg

SEQ ID NO: 525395 - RNA, 32 nt, Human
ugggggcucgaauccagguugaagggucacca

SEQ ID NO: 525396 - RNA, 32 nt, Human
ugggggcucuggaaggaugggccagcuugcag

SEQ ID NO: 525397 - RNA, 32 nt, Human
ugggggcugaggcagaggcagggauagcuggg

SEQ ID NO: 525398 - RNA, 32 nt, Human
ugggggcugagucucugaaaagucuaagaagc

SEQ ID NO: 525399 - RNA, 32 nt, Human
ugggggcugcaggcgcgcuaggagaacuaugc

SEQ ID NO: 525400 - RNA, 21 nt, Human
ugggggcugccaggggcccuc

SEQ ID NO: 525401 - RNA, 32 nt, Human
ugggggcugcccacagaugggcagucucagcc

SEQ ID NO: 525402 - RNA, 21 nt, Human
ugggggcugccgcggacacug

SEQ ID NO: 525403 - RNA, 32 nt, Human
ugggggcugccuggacuggucuggcagguugg

SEQ ID NO: 525404 - RNA, 32 nt, Human
ugggggcugcuggggccagggucgggcaugca

SEQ ID NO: 525405 - RNA, 32 nt, Human
ugggggcuggaaccccuccccgggaggagugc

SEQ ID NO: 525406 - RNA, 32 nt, Human
ugggggcuggacuggccuggucuggcugggaa

SEQ ID NO: 525407 - RNA, 21 nt, Human
ugggggcuggcagcagacccc

SEQ ID NO: 525408 - RNA, 32 nt, Human
ugggggcuggcaucccagcuccaacucgagga

SEQ ID NO: 525409 - RNA, 32 nt, Human
ugggggcuggccagucagggagggcuaggggg

SEQ ID NO: 525410 - RNA, 32 nt, Human
ugggggcugggaacagcagaggggauagaagu

SEQ ID NO: 525411 - RNA, 18 nt, Human
ugggggcuguagggcccu

SEQ ID NO: 525412 - RNA, 22 nt, Human
ugggggcugugugucaugcuca

SEQ ID NO: 525413 - RNA, 32 nt, Human
ugggggcuuuuauuccccuccuugagccccag

SEQ ID NO: 525414 - RNA, 25 nt, Human
uggggggaaagggacuucuagcaaa

SEQ ID NO: 525415 - RNA, 21 nt, Human
uggggggaaauguuacgcaaa

SEQ ID NO: 525416 - RNA, 21 nt, Human
uggggggaaauuaccaguaga

SEQ ID NO: 525417 - RNA, 23 nt, Human
uggggggaagaauccuuaccaag

SEQ ID NO: 525418 - RNA, 20 nt, Human
uggggggaagaugcgggaaa

SEQ ID NO: 525419 - RNA, 19 nt, Human
uggggggaaggaaagcgga

SEQ ID NO: 525420 - RNA, 22 nt, Human
uggggggaauguucucagcaga

SEQ ID NO: 525421 - RNA, 20 nt, Human
uggggggaggacccugugaa

SEQ ID NO: 525422 - RNA, 20 nt, Human
uggggggagggcccgggaaa

SEQ ID NO: 525423 - RNA, 18 nt, Human
uggggggagugccagcaa

SEQ ID NO: 525424 - RNA, 19 nt, Human
uggggggauggugagcaaa

SEQ ID NO: 525425 - RNA, 18 nt, Human
uggggggcaggggcccuc

SEQ ID NO: 525426 - RNA, 17 nt, Human
uggggggccacacacuc

SEQ ID NO: 525427 - RNA, 21 nt, Human
ugggggguaaugaacuaaaga

SEQ ID NO: 525428 - RNA, 21 nt, Human
ugggggguaggguuuuguaaa

SEQ ID NO: 525429 - RNA, 19 nt, Human
uggggggugacccccaagg

SEQ ID NO: 525430 - RNA, 23 nt, Human
ugggggguggccagcggcccccu

SEQ ID NO: 525431 - RNA, 32 nt, Human
uggggguaaggagggaaggaagagggaaagag

SEQ ID NO: 525432 - RNA, 32 nt, Human
uggggguaagggggaccagagaggcgggcugg

SEQ ID NO: 525433 - RNA, 32 nt, Human
uggggguagcagacuggagcccaggggugaug

SEQ ID NO: 525434 - RNA, 32 nt, Human
uggggguagggaggggagaguuaaccugcugg

SEQ ID NO: 525435 - RNA, 32 nt, Human
uggggguaggguggggguggggagaacacuua

SEQ ID NO: 525436 - RNA, 32 nt, Human
uggggguaguaaggcuggaguggguagaggaa

SEQ ID NO: 525437 - RNA, 32 nt, Human
ugggggucagaagaagugggagcagcuucuug

SEQ ID NO: 525438 - RNA, 32 nt, Human
ugggggucagcagggcggagcggcuuuuccag

SEQ ID NO: 525439 - RNA, 32 nt, Human
uggggguccuaagagccaggggaugaaaaggg

SEQ ID NO: 525440 - RNA, 32 nt, Human
ugggggucucacuauguugcccaggcuggucu

SEQ ID NO: 525441 - RNA, 32 nt, Human
ugggggucucacuguguugcucuggcuggucu

SEQ ID NO: 525442 - RNA, 23 nt, Human
ugggggucugggcguccagcuca

SEQ ID NO: 525443 - RNA, 17 nt, Human
ugggggucuucccagca

SEQ ID NO: 525444 - RNA, 18 nt, Human
ugggggucuucccagcaa

SEQ ID NO: 525445 - RNA, 32 nt, Human
ugggggucuucccagcaacaucagcucuguca

SEQ ID NO: 525446 - RNA, 32 nt, Human
ugggggugaaagacggggccacugcagcccuu

SEQ ID NO: 525447 - RNA, 32 nt, Human
ugggggugacaugggccagauccuccugcccc

SEQ ID NO: 525448 - RNA, 32 nt, Human
ugggggugacgauaucuaccucuuggggugug

SEQ ID NO: 525449 - RNA, 32 nt, Human
ugggggugagccugaaggccacagagaaagaa

SEQ ID NO: 525450 - RNA, 32 nt, Human
ugggggugaggaggacaagaaggagaggaaaa

SEQ ID NO: 525451 - RNA, 22 nt, Human
ugggggugaggauuccagagga

SEQ ID NO: 525452 - RNA, 32 nt, Human
ugggggugaugccaguuagaaguggguaguga

SEQ ID NO: 525453 - RNA, 32 nt, Human
ugggggugcagaagucuuuuuaucucuauaua

SEQ ID NO: 525454 - RNA, 32 nt, Human
ugggggugccgcucuaaauuggcuccauauca

SEQ ID NO: 525455 - RNA, 32 nt, Human
ugggggugccugagugcugugaccaagggacu

SEQ ID NO: 525456 - RNA, 22 nt, Human
ugggggugccugauugauccua

SEQ ID NO: 525457 - RNA, 32 nt, Human
ugggggugcuaucaggguaacacugccugcag

SEQ ID NO: 525458 - RNA, 32 nt, Human
uggggguggaaaggacagagcccaggcgaccu

SEQ ID NO: 525459 - RNA, 32 nt, Human
uggggguggcagacgagcccacggcgccgugg

SEQ ID NO: 525460 - RNA, 32 nt, Human
ugggggugggagugagcccaccacagaggcca

SEQ ID NO: 525461 - RNA, 32 nt, Human
ugggggugggcugugcucagagcagggagcgg

SEQ ID NO: 525462 - RNA, 32 nt, Human
uggggguggggaaaagcccaggagagcagugg

SEQ ID NO: 525463 - RNA, 32 nt, Human
uggggguggggaagggaggccgccacagcucc

SEQ ID NO: 525464 - RNA, 32 nt, Human
uggggguggggcaccccagcugcccugacaga

SEQ ID NO: 525465 - RNA, 32 nt, Human
uggggguggggcgccuuccuggaggugacacu

SEQ ID NO: 525466 - RNA, 32 nt, Human
ugggggugggggaggagguugagggaacaggg

SEQ ID NO: 525467 - RNA, 32 nt, Human
ugggggugggggugguaaggggagaccgggga

SEQ ID NO: 525468 - RNA, 32 nt, Human
uggggguggguaagggaggggaugguuuaugu

SEQ ID NO: 525469 - RNA, 19 nt, Human
ugggggugggucugaggga

SEQ ID NO: 525470 - RNA, 31 nt, Human
uggggguggguggccggguggguggagcguu

SEQ ID NO: 525471 - RNA, 31 nt, Human
uggggguggguggggagcuuuuggggaggac

SEQ ID NO: 525472 - RNA, 31 nt, Human
uggggguggguggguggauaucuuaauuuuu

SEQ ID NO: 525473 - RNA, 24 nt, Human
ugggggugguagcacauaccugua

SEQ ID NO: 525474 - RNA, 32 nt, Human
uggggguggugaggaccugauagaguuggauc

SEQ ID NO: 525475 - RNA, 32 nt, Human
uggggguguaugggguagauggguggagaggg

SEQ ID NO: 525476 - RNA, 32 nt, Human
ugggggugucuuuuucuuuucauaaaguaaca

SEQ ID NO: 525477 - RNA, 32 nt, Human
uggggguguugguguuuccucccuggagaaga

SEQ ID NO: 525478 - RNA, 32 nt, Human
uggggguucagaucgauggccuuguccauguu

SEQ ID NO: 525479 - RNA, 32 nt, Human
uggggguucccaggagccaugcguggccugca

SEQ ID NO: 525480 - RNA, 32 nt, Human
uggggguuccugcagcaacccccagccucagu

SEQ ID NO: 525481 - RNA, 32 nt, Human
uggggguucuguagccggaggcggcggcgagu

SEQ ID NO: 525482 - RNA, 32 nt, Human
uggggguugaguuuuggccuucauccuuguag

SEQ ID NO: 525483 - RNA, 32 nt, Human
uggggguuggagaagggugaggggcuuccccc

SEQ ID NO: 525484 - RNA, 21 nt, Human
uggggguugggacccagcaag

SEQ ID NO: 525485 - RNA, 32 nt, Human
uggggguuguuaucacagaagauacugucuca

SEQ ID NO: 525486 - RNA, 18 nt, Human
uggggguuuccuagcaga

SEQ ID NO: 525487 - RNA, 32 nt, Human
uggggguuuugccauguugcccaagcaggucu

SEQ ID NO: 525488 - RNA, 32 nt, Human
ugggguaaagaauuuggugagaaggagcugaa

SEQ ID NO: 525489 - RNA, 32 nt, Human
ugggguaacccgaggugcagagcugagaauga

SEQ ID NO: 525490 - RNA, 32 nt, Human
ugggguaagcauuuucauucuuccugcugaag

SEQ ID NO: 525491 - RNA, 32 nt, Human
ugggguaaguggucuugaaggauucauuuagu

SEQ ID NO: 525492 - RNA, 32 nt, Human
ugggguaauuuucuucaaagggaguuuguuau

SEQ ID NO: 525493 - RNA, 32 nt, Human
ugggguaccacccccagggcaggauggggaca

SEQ ID NO: 525494 - RNA, 32 nt, Human
ugggguacgguggcaugaucauggcucacugc

SEQ ID NO: 525495 - RNA, 32 nt, Human
ugggguacuacacucaccaccugggugacggg

SEQ ID NO: 525496 - RNA, 32 nt, Human
ugggguacuggcagagcuguggcucgaauucc

SEQ ID NO: 525497 - RNA, 32 nt, Human
ugggguagaaaggcuuccccuacccugggccc

SEQ ID NO: 525498 - RNA, 32 nt, Human
ugggguagaacucgucagugaagaggggcuca

SEQ ID NO: 525499 - RNA, 32 nt, Human
ugggguagaacucgucagugaagaggggcucg

SEQ ID NO: 525500 - RNA, 32 nt, Human
ugggguagagaccaacccugaggacucagugu

SEQ ID NO: 525501 - RNA, 32 nt, Human
ugggguagauucuugagaagcauuucauauaa

SEQ ID NO: 525502 - RNA, 32 nt, Human
ugggguagcgacagacaaucccagaaacacgc

SEQ ID NO: 525503 - RNA, 21 nt, Human
ugggguaggccgggugcagug

SEQ ID NO: 525504 - RNA, 32 nt, Human
ugggguagggcaccacccccuccuggggugag

SEQ ID NO: 525505 - RNA, 18 nt, Human
ugggguaggucggggaga

SEQ ID NO: 525506 - RNA, 32 nt, Human
ugggguaucucccauuacccaugucgcccuca

SEQ ID NO: 525507 - RNA, 32 nt, Human
ugggguaugauggcugacugcucauuguuccc

SEQ ID NO: 525508 - RNA, 20 nt, Human
ugggguauggaggggcccuu

SEQ ID NO: 525509 - RNA, 32 nt, Human
uggggucaaaucagcuccuucucuccaagugc

SEQ ID NO: 525510 - RNA, 32 nt, Human
uggggucaagaaggaaaaugugugugagcaug

SEQ ID NO: 525511 - RNA, 32 nt, Human
uggggucaagacagaugacaccagcacuuuaa

SEQ ID NO: 525512 - RNA, 32 nt, Human
uggggucaagacaggugacaccagcacuuuaa

SEQ ID NO: 525513 - RNA, 32 nt, Human
uggggucaagccauccucccaccucagcuuuc

SEQ ID NO: 525514 - RNA, 32 nt, Human
uggggucaaggaacaggaagcugaccuggaug

SEQ ID NO: 525515 - RNA, 32 nt, Human
uggggucaaggcagcaggacugaucaagugac

SEQ ID NO: 525516 - RNA, 32 nt, Human
uggggucaccacccuccccugucuucucucaa

SEQ ID NO: 525517 - RNA, 32 nt, Human
uggggucacuucgugaauucaccagagacuca

SEQ ID NO: 525518 - RNA, 32 nt, Human
uggggucagaccuugcaucucagucagcccag

SEQ ID NO: 525519 - RNA, 32 nt, Human
uggggucagagcagugcccgaggaagcggggu

SEQ ID NO: 525520 - RNA, 32 nt, Human
uggggucagaggccgggacacugaggcagcag

SEQ ID NO: 525521 - RNA, 32 nt, Human
uggggucagagugguucucccagggccuucaa

SEQ ID NO: 525522 - RNA, 32 nt, Human
uggggucagccacugccaauccugccuuacuc

SEQ ID NO: 525523 - RNA, 32 nt, Human
uggggucagcccucgucacacugcggcacagg

SEQ ID NO: 525524 - RNA, 32 nt, Human
uggggucagcucagcucccugccuugucacau

SEQ ID NO: 525525 - RNA, 32 nt, Human
uggggucaggaaaaugccaggggacaugagcu

SEQ ID NO: 525526 - RNA, 32 nt, Human
uggggucaggaacaucuggcagagggaggucc

SEQ ID NO: 525527 - RNA, 18 nt, Human
uggggucaggaagaggag

SEQ ID NO: 525528 - RNA, 32 nt, Human
uggggucaggaguucaaaaccagccuggccaa

SEQ ID NO: 525529 - RNA, 32 nt, Human
uggggucaggaguucaagaccagccugcccaa

SEQ ID NO: 525530 - RNA, 18 nt, Human
uggggucaggaugacgag

SEQ ID NO: 525531 - RNA, 18 nt, Human
uggggucaggccccagag

SEQ ID NO: 525532 - RNA, 32 nt, Human
uggggucagggaggaaaggcagaagcugggag

SEQ ID NO: 525533 - RNA, 32 nt, Human
uggggucaggguuugagaccagccuggccaac

SEQ ID NO: 525534 - RNA, 32 nt, Human
uggggucaggugagcagccaccagaggcaugg

SEQ ID NO: 525535 - RNA, 32 nt, Human
uggggucagguguggagaucagggucggggag

SEQ ID NO: 525536 - RNA, 19 nt, Human
uggggucaguuccagcaga

SEQ ID NO: 525537 - RNA, 32 nt, Human
uggggucauaagcaacagcaguagaagguggc

SEQ ID NO: 525538 - RNA, 32 nt, Human
uggggucauaggucugcacagagcaggcguag

SEQ ID NO: 525539 - RNA, 32 nt, Human
uggggucauugccauccucccuacucaugacu

SEQ ID NO: 525540 - RNA, 32 nt, Human
ugggguccaaaccacauguguccugccucucc

SEQ ID NO: 525541 - RNA, 32 nt, Human
ugggguccaggcugggccaggagaccaggcag

SEQ ID NO: 525542 - RNA, 32 nt, Human
ugggguccaucaccccaggggguccauaguug

SEQ ID NO: 525543 - RNA, 32 nt, Human
uggggucccagcugccugccugccucuuagga

SEQ ID NO: 525544 - RNA, 32 nt, Human
ugggguccgcagacuacugccacccacucacc

SEQ ID NO: 525545 - RNA, 32 nt, Human
ugggguccuagcaaccuccacauguucaccua

SEQ ID NO: 525546 - RNA, 32 nt, Human
ugggguccucacugcagcuggccucuggcagc

SEQ ID NO: 525547 - RNA, 32 nt, Human
ugggguccucuugguucugccugcagccugcc

SEQ ID NO: 525548 - RNA, 32 nt, Human
ugggguccugacugaagaagguguccaggggg

SEQ ID NO: 525549 - RNA, 32 nt, Human
ugggguccugcagaauccaaguuuacaaacca

SEQ ID NO: 525550 - RNA, 32 nt, Human
ugggguccugggagguggucgcccugcagugc

SEQ ID NO: 525551 - RNA, 18 nt, Human
ugggguccuguggggccc

SEQ ID NO: 525552 - RNA, 32 nt, Human
ugggguccuugagacagaggcaggacccucgu

SEQ ID NO: 525553 - RNA, 32 nt, Human
ugggguccuugaugggcaugugugauggggaa

SEQ ID NO: 525554 - RNA, 32 nt, Human
uggggucggccaggacccucacagcucugaau

SEQ ID NO: 525555 - RNA, 32 nt, Human
uggggucgggaggagagagauggggaagcuga

SEQ ID NO: 525556 - RNA, 28 nt, Human
uggggucgggucacugccucauccaccg

SEQ ID NO: 525557 - RNA, 32 nt, Human
uggggucucaaggcuggagucaaggugauggc

SEQ ID NO: 525558 - RNA, 32 nt, Human
uggggucucagaggaaugauggaagccuuggg

SEQ ID NO: 525559 - RNA, 32 nt, Human
uggggucucaggagucaggcagggccagcaca

SEQ ID NO: 525560 - RNA, 32 nt, Human
uggggucuccagccuggcugcugcugggcccu

SEQ ID NO: 525561 - RNA, 32 nt, Human
uggggucuccaucaccgggaccuggagaggga

SEQ ID NO: 525562 - RNA, 32 nt, Human
uggggucuccugggacccgccuguugcuucug

SEQ ID NO: 525563 - RNA, 18 nt, Human
uggggucucgcucuguca

SEQ ID NO: 525564 - RNA, 21 nt, Human
uggggucucgggucacugcag

SEQ ID NO: 525565 - RNA, 32 nt, Human
uggggucucuaggagcucugcaggccccagca

SEQ ID NO: 525566 - RNA, 32 nt, Human
uggggucugccuggccuguggguucugccggu

SEQ ID NO: 525567 - RNA, 32 nt, Human
uggggucugccugguccuugagccccugaguu

SEQ ID NO: 525568 - RNA, 32 nt, Human
uggggucugcugaauuggcuucuuuucuuuug

SEQ ID NO: 525569 - RNA, 32 nt, Human
uggggucugggagggggugagaggcaggaaug

SEQ ID NO: 525570 - RNA, 32 nt, Human
uggggucugggcacucugccucugggagagag

SEQ ID NO: 525571 - RNA, 32 nt, Human
uggggucugggcuccagccagagaacaaucuu

SEQ ID NO: 525572 - RNA, 32 nt, Human
uggggucuguaugccuuugucuugucauuugc

SEQ ID NO: 525573 - RNA, 32 nt, Human
uggggucuuacagaugugucucugaguaguaa

SEQ ID NO: 525574 - RNA, 32 nt, Human
uggggugaaagggaggauugaagaaugccgcg

SEQ ID NO: 525575 - RNA, 32 nt, Human
uggggugaaggcccugauacacgcaccuaccu

SEQ ID NO: 525576 - RNA, 32 nt, Human
uggggugagaggaggcccaggaggagagagag

SEQ ID NO: 525577 - RNA, 32 nt, Human
uggggugagcaucaguccuggcucugcugguc

SEQ ID NO: 525578 - RNA, 32 nt, Human
uggggugagccaccuccaacagaugccaaccu

SEQ ID NO: 525579 - RNA, 32 nt, Human
uggggugagccuggggacaguggagccucuga

SEQ ID NO: 525580 - RNA, 32 nt, Human
uggggugagccugucuguccucccucagagcc

SEQ ID NO: 525581 - RNA, 32 nt, Human
uggggugagggacagagccccacgcuguugac

SEQ ID NO: 525582 - RNA, 32 nt, Human
uggggugaucccgggcuaggggagcgcggcgg

SEQ ID NO: 525583 - RNA, 32 nt, Human
uggggugauggagaagaaacaggcugugcugu

SEQ ID NO: 525584 - RNA, 32 nt, Human
uggggugcaaaggaaaggugggugagggaagc

SEQ ID NO: 525585 - RNA, 32 nt, Human
uggggugcaagcugccgcguucccuggcuggu

SEQ ID NO: 525586 - RNA, 32 nt, Human
uggggugcagaggcacggggagagggaggaug

SEQ ID NO: 525587 - RNA, 32 nt, Human
uggggugcagaggcagaagaugaaggacaaaa

SEQ ID NO: 525588 - RNA, 32 nt, Human
uggggugcagcgucuggucagccgagggugaa

SEQ ID NO: 525589 - RNA, 32 nt, Human
uggggugcaggcauugcacagagcaugaaugg

SEQ ID NO: 525590 - RNA, 32 nt, Human
uggggugcagggagggagaggcaggggagaga

SEQ ID NO: 525591 - RNA, 32 nt, Human
uggggugcagggugcaccuguacuggaaaauu

SEQ ID NO: 525592 - RNA, 32 nt, Human
uggggugcaguggcacaaucauggcucacugc

SEQ ID NO: 525593 - RNA, 32 nt, Human
uggggugcaguggcacgaucuuggcucacugu

SEQ ID NO: 525594 - RNA, 32 nt, Human
uggggugcaguggcgugaucuuggcucacugc

SEQ ID NO: 525595 - RNA, 32 nt, Human
uggggugccaguggaagagagaaagcaggcga

SEQ ID NO: 525596 - RNA, 19 nt, Human
uggggugccuguaguccca

SEQ ID NO: 525597 - RNA, 22 nt, Human
uggggugccuguagucccagcu

SEQ ID NO: 525598 - RNA, 32 nt, Human
uggggugccuguagucccagcuacucgggagg

SEQ ID NO: 525599 - RNA, 32 nt, Human
uggggugcgcgcacuccuucagcguguccugg

SEQ ID NO: 525600 - RNA, 32 nt, Human
uggggugcucagaucucucaggaaaaccaguu

SEQ ID NO: 525601 - RNA, 32 nt, Human
uggggugcuccuggggcgggaggggcgcgcuc

SEQ ID NO: 525602 - RNA, 32 nt, Human
uggggugcucuucccccuccuuauaaauguuc

SEQ ID NO: 525603 - RNA, 32 nt, Human
uggggugcugcgugcgcugccugcucccgccu

SEQ ID NO: 525604 - RNA, 32 nt, Human
uggggugcugcuguaccacacagccaagggga

SEQ ID NO: 525605 - RNA, 32 nt, Human
uggggugcuggacuggcccuccagaggguaag

SEQ ID NO: 525606 - RNA, 32 nt, Human
uggggugcugggcuccccuagacuaggacucc

SEQ ID NO: 525607 - RNA, 32 nt, Human
uggggugcugugguaauaagaagcuaugacau

SEQ ID NO: 525608 - RNA, 32 nt, Human
uggggugcugugguccaagaaggacccagcuu

SEQ ID NO: 525609 - RNA, 32 nt, Human
ugggguggaagagggacagccggcugggccac

SEQ ID NO: 525610 - RNA, 32 nt, Human
ugggguggacucagaugccaggaaagggacag

SEQ ID NO: 525611 - RNA, 32 nt, Human
ugggguggagagguggggugggguggggugug

SEQ ID NO: 525612 - RNA, 32 nt, Human
ugggguggaggaucagucacacugcugagugu

SEQ ID NO: 525613 - RNA, 32 nt, Human
ugggguggagggaggaagggcugggagggagu

SEQ ID NO: 525614 - RNA, 32 nt, Human
ugggguggcacaugccuguaaucccagcacuu

SEQ ID NO: 525615 - RNA, 32 nt, Human
ugggguggcagcagggacagaaaacaacagag

SEQ ID NO: 525616 - RNA, 20 nt, Human
ugggguggccagccaagagg

SEQ ID NO: 525617 - RNA, 32 nt, Human
ugggguggcccaggcagcagaagguucccuga

SEQ ID NO: 525618 - RNA, 32 nt, Human
ugggguggccccaggguagguaacagucuuag

SEQ ID NO: 525619 - RNA, 32 nt, Human
ugggguggccuauggaccuggcccaucugcca

SEQ ID NO: 525620 - RNA, 32 nt, Human
ugggguggccugcagugacacagaaaggaaga

SEQ ID NO: 525621 - RNA, 32 nt, Human
ugggguggcucaugccuguaaucccaguacuu

SEQ ID NO: 525622 - RNA, 32 nt, Human
ugggguggcuccugccccuucugcccugccuu

SEQ ID NO: 525623 - RNA, 32 nt, Human
ugggguggcuccugccucacccucugcccagc

SEQ ID NO: 525624 - RNA, 32 nt, Human
uggggugggaaccuggggugugguuccagaaa

SEQ ID NO: 525625 - RNA, 32 nt, Human
uggggugggaagaucacuugagcccaggaggu

SEQ ID NO: 525626 - RNA, 30 nt, Human
uggggugggagccacagggacgacccgggg

SEQ ID NO: 525627 - RNA, 32 nt, Human
uggggugggaggaucacaugaacccaggaggu

SEQ ID NO: 525628 - RNA, 32 nt, Human
uggggugggaggauccauugagaccaggagau

SEQ ID NO: 525629 - RNA, 32 nt, Human
uggggugggaggaucgcuugaacccaggaggu

SEQ ID NO: 525630 - RNA, 32 nt, Human
uggggugggaggauggcgggggcagggggccg

SEQ ID NO: 525631 - RNA, 32 nt, Human
uggggugggaggauggcuugagcccaggaguu

SEQ ID NO: 525632 - RNA, 19 nt, Human
uggggugggagggcagggg

SEQ ID NO: 525633 - RNA, 32 nt, Human
uggggugggagggcaggggugggagcccuccu

SEQ ID NO: 525634 - RNA, 32 nt, Human
uggggugggauaaggggaaggagaagagggag

SEQ ID NO: 525635 - RNA, 32 nt, Human
uggggugggcacucaccucagcagagccucaa

SEQ ID NO: 525636 - RNA, 32 nt, Human
uggggugggcagauugcuugagcugaggaguu

SEQ ID NO: 525637 - RNA, 32 nt, Human
uggggugggcagggcugggagaacuuuguaca

SEQ ID NO: 525638 - RNA, 32 nt, Human
uggggugggcagguucagcugugagagaggcu

SEQ ID NO: 525639 - RNA, 32 nt, Human
uggggugggcccugucauucgugguugauuuc

SEQ ID NO: 525640 - RNA, 32 nt, Human
ugggguggggaaagguggcccaguggagccgg

SEQ ID NO: 525641 - RNA, 32 nt, Human
ugggguggggacccguccaaggacaggcuggc

SEQ ID NO: 525642 - RNA, 32 nt, Human
ugggguggggaccgggugaggggccugacggc

SEQ ID NO: 525643 - RNA, 32 nt, Human
ugggguggggagcagagcuggagcucgaucau

SEQ ID NO: 525644 - RNA, 32 nt, Human
ugggguggggauccuugggaagaauuacuccc

SEQ ID NO: 525645 - RNA, 20 nt, Human
ugggguggggaucuugcaaa

SEQ ID NO: 525646 - RNA, 32 nt, Human
ugggguggggccagaggagcucuccagcccug

SEQ ID NO: 525647 - RNA, 32 nt, Human
ugggguggggcugaagccuagggggugggccg

SEQ ID NO: 525648 - RNA, 22 nt, Human
uggggugggggauuccaucaaa

SEQ ID NO: 525649 - RNA, 32 nt, Human
uggggugggggcccugcuggcaacccugagcc

SEQ ID NO: 525650 - RNA, 32 nt, Human
uggggugggggugggaagaccccugaugcagc

SEQ ID NO: 525651 - RNA, 32 nt, Human
uggggugggguaggcagaugggccaaggugac

SEQ ID NO: 525652 - RNA, 32 nt, Human
uggggugggguggucagggugagcaggugggc

SEQ ID NO: 525653 - RNA, 32 nt, Human
ugggguggguagcugggggcccggacacuugg

SEQ ID NO: 525654 - RNA, 32 nt, Human
uggggugggugagcagaguucaaggaagccca

SEQ ID NO: 525655 - RNA, 32 nt, Human
uggggugggugaggacgggugggagggacagg

SEQ ID NO: 525656 - RNA, 32 nt, Human
ugggguggguggacccuggagacucucaggug

SEQ ID NO: 525657 - RNA, 32 nt, Human
ugggguggugccacugcgcuccagccuggggg

SEQ ID NO: 525658 - RNA, 32 nt, Human
uggggugguggcggccccugaggcagaccagg

SEQ ID NO: 525659 - RNA, 32 nt, Human
ugggguguaaagugccaugacugaauaaucuu

SEQ ID NO: 525660 - RNA, 32 nt, Human
uggggugucccaaggcugggcaccaaggcagg

SEQ ID NO: 525661 - RNA, 32 nt, Human
ugggguguccccggcagccacacacagccaug

SEQ ID NO: 525662 - RNA, 17 nt, Human
ugggguguccugggcuc

SEQ ID NO: 525663 - RNA, 19 nt, Human
uggggugucugcugggccc

SEQ ID NO: 525664 - RNA, 15 nt, Human
uggggugucuggcuc

SEQ ID NO: 525665 - RNA, 32 nt, Human
uggggugugacacuuuugagcgguugaauugg

SEQ ID NO: 525666 - RNA, 20 nt, Human
uggggugugagugagcucuc

SEQ ID NO: 525667 - RNA, 32 nt, Human
uggggugugcccuggggagccucagaagccug

SEQ ID NO: 525668 - RNA, 32 nt, Human
uggggugugccuguagucccagcuacuugaga

SEQ ID NO: 525669 - RNA, 32 nt, Human
uggggugugcugcugcugcuccccagcccacc

SEQ ID NO: 525670 - RNA, 32 nt, Human
uggggugugcuuguguggagugugcgugugca

SEQ ID NO: 525671 - RNA, 17 nt, Human
uggggugugggaggccc

SEQ ID NO: 525672 - RNA, 32 nt, Human
uggggugugggaggggcggggagguuuucuau

SEQ ID NO: 525673 - RNA, 32 nt, Human
uggggugugguggcucaugccuguaauccuag

SEQ ID NO: 525674 - RNA, 32 nt, Human
ugggguguggugugugcccucauagauggggg

SEQ ID NO: 525675 - RNA, 32 nt, Human
uggggugugguguguuucugugccagugcugu

SEQ ID NO: 525676 - RNA, 32 nt, Human
ugggguguguuuuucgguauguagggagaaaa

SEQ ID NO: 525677 - RNA, 16 nt, Human
ugggguguuuauagcc

SEQ ID NO: 525678 - RNA, 32 nt, Human
ugggguguuugugcaaccuucaucugcacugg

SEQ ID NO: 525679 - RNA, 32 nt, Human
ugggguuagggagguggggaagagauaaucuu

SEQ ID NO: 525680 - RNA, 32 nt, Human
ugggguuaucucuguguuagggguauaugaug

SEQ ID NO: 525681 - RNA, 20 nt, Human
ugggguuaugucccaguaaa

SEQ ID NO: 525682 - RNA, 32 nt, Human
ugggguucaagcaauccucccaccucaaccca

SEQ ID NO: 525683 - RNA, 32 nt, Human
ugggguucaagcaaucugcccaccucagccuc

SEQ ID NO: 525684 - RNA, 32 nt, Human
ugggguucaagcgauccucccaccucagccuc

SEQ ID NO: 525685 - RNA, 32 nt, Human
ugggguucaagugauccucccaccucagccuc

SEQ ID NO: 525686 - RNA, 32 nt, Human
ugggguucaauugaaaaggaacaugacaaacu

SEQ ID NO: 525687 - RNA, 32 nt, Human
ugggguucauucuuucaacaaauauacauuga

SEQ ID NO: 525688 - RNA, 18 nt, Human
ugggguuccaccauguca

SEQ ID NO: 525689 - RNA, 32 nt, Human
ugggguucccauuugacuccagucccaggcag

SEQ ID NO: 525690 - RNA, 24 nt, Human
ugggguucccccuccacccagugg

SEQ ID NO: 525691 - RNA, 32 nt, Human
ugggguuccuuuccuuuccugcuuccaccaug

SEQ ID NO: 525692 - RNA, 32 nt, Human
ugggguucuccuccucucccagggccuccuug

SEQ ID NO: 525693 - RNA, 21 nt, Human
ugggguucugggucgguucca

SEQ ID NO: 525694 - RNA, 32 nt, Human
ugggguucugucuucuuugauagccaucuauu

SEQ ID NO: 525695 - RNA, 32 nt, Human
ugggguucuuugagugggggaggcagggacga

SEQ ID NO: 525696 - RNA, 21 nt, Human
ugggguugaaguuugguuugg

SEQ ID NO: 525697 - RNA, 32 nt, Human
ugggguugagcagaggagaaaaucagaaagau

SEQ ID NO: 525698 - RNA, 32 nt, Human
ugggguugagcagaggagaaaaucagacagau

SEQ ID NO: 525699 - RNA, 32 nt, Human
ugggguugcaacaucuuuuaacuucucaguua

SEQ ID NO: 525700 - RNA, 32 nt, Human
ugggguugcaguauuguauaaaaucauaggau

SEQ ID NO: 525701 - RNA, 32 nt, Human
ugggguugcccagccuggagcggagcuugccu

SEQ ID NO: 525702 - RNA, 22 nt, Human
ugggguugccucccccuccugc

SEQ ID NO: 525703 - RNA, 21 nt, Human
ugggguuggaaagucagcugg

SEQ ID NO: 525704 - RNA, 20 nt, Human
ugggguuggaggccuggcug

SEQ ID NO: 525705 - RNA, 32 nt, Human
ugggguuggcagcugcucauucaugauggccu

SEQ ID NO: 525706 - RNA, 19 nt, Human
ugggguuggccagggcccu

SEQ ID NO: 525707 - RNA, 32 nt, Human
ugggguugggauccuuggaauauuucaauaaa

SEQ ID NO: 525708 - RNA, 32 nt, Human
ugggguuggggguggaggucuagaggugagcu

SEQ ID NO: 525709 - RNA, 32 nt, Human
ugggguugggguuguuuagggagaagcagcca

SEQ ID NO: 525710 - RNA, 32 nt, Human
ugggguugugggguggaggcuggcagcugaaa

SEQ ID NO: 525711 - RNA, 24 nt, Human
ugggguuguggugacuccagugga

SEQ ID NO: 525712 - RNA, 18 nt, Human
ugggguuuaccagcugga

SEQ ID NO: 525713 - RNA, 19 nt, Human
ugggguuucaagacaggga

SEQ ID NO: 525714 - RNA, 32 nt, Human
ugggguuucauuguucccgcugggccgggcgg

SEQ ID NO: 525715 - RNA, 21 nt, Human
ugggguuucccagccacugga

SEQ ID NO: 525716 - RNA, 17 nt, Human
ugggguuucccauguug

SEQ ID NO: 525717 - RNA, 16 nt, Human
ugggguuuccccaggg

SEQ ID NO: 525718 - RNA, 32 nt, Human
ugggguuugaugaucucggugcagauggugcu

SEQ ID NO: 525719 - RNA, 32 nt, Human
ugggguuugcagcugccacugagcuguagcug

SEQ ID NO: 525720 - RNA, 32 nt, Human
ugggguuuggagcccaccuacucucuggcagc

SEQ ID NO: 525721 - RNA, 32 nt, Human
ugggguuugucuucugugugccuguguccuca

SEQ ID NO: 525722 - RNA, 32 nt, Human
ugggguuuugcuucugucugucuguuuauugg

SEQ ID NO: 525723 - RNA, 32 nt, Human
ugggguuuuggccagcacagagccggggcguu

SEQ ID NO: 525724 - RNA, 32 nt, Human
uggguaacacauauggagguuugcugccauau

SEQ ID NO: 525725 - RNA, 32 nt, Human
uggguaacauggccagaccccaucucuauuua

SEQ ID NO: 525726 - RNA, 32 nt, Human
uggguaaccagaaaagggcuucacccauuugu

SEQ ID NO: 525727 - RNA, 32 nt, Human
uggguaagaauagaaagccacaggucuagcag

SEQ ID NO: 525728 - RNA, 32 nt, Human
uggguaauaguugcaugaaaacuuuugaacgu

SEQ ID NO: 525729 - RNA, 32 nt, Human
uggguaauauggcaaaaccccaucucuacuaa

SEQ ID NO: 525730 - RNA, 32 nt, Human
uggguaaucucuuaugggugggaggugagauu

SEQ ID NO: 525731 - RNA, 32 nt, Human
uggguacagaugggcauaggugcagugagugc

SEQ ID NO: 525732 - RNA, 24 nt, Human
uggguacaggggcauauaccugua

SEQ ID NO: 525733 - RNA, 32 nt, Human
uggguacagguaaaagccagacuuggcaggga

SEQ ID NO: 525734 - RNA, 32 nt, Human
uggguacaggugggcauaggugcagugagugc

SEQ ID NO: 525735 - RNA, 24 nt, Human
uggguacaguggcucacaccugua

SEQ ID NO: 525736 - RNA, 24 nt, Human
uggguacaguggcucacgccugua

SEQ ID NO: 525737 - RNA, 32 nt, Human
uggguacaucuuguaagacacauaaugagguc

SEQ ID NO: 525738 - RNA, 32 nt, Human
uggguaccaagcucccaggcccuuccucuauc

SEQ ID NO: 525739 - RNA, 32 nt, Human
uggguaccacaggaaccugggggccugugaaa

SEQ ID NO: 525740 - RNA, 32 nt, Human
uggguaccagcucuggcaguuggcaucaaugu

SEQ ID NO: 525741 - RNA, 32 nt, Human
uggguacccgagagacccggcgguggggaagu

SEQ ID NO: 525742 - RNA, 32 nt, Human
uggguacccucaccccugccucaggcugauua

SEQ ID NO: 525743 - RNA, 32 nt, Human
uggguaccgcuacuugggaggcugaggcagga

SEQ ID NO: 525744 - RNA, 32 nt, Human
uggguaccugcucuccgagucugugucuccag

SEQ ID NO: 525745 - RNA, 32 nt, Human
uggguaccuguaaucccagcuacuugggaggc

SEQ ID NO: 525746 - RNA, 32 nt, Human
uggguaccuguaaucccaguuacuuuggaggc

SEQ ID NO: 525747 - RNA, 24 nt, Human
uggguacgguggcucaugccugua

SEQ ID NO: 525748 - RNA, 32 nt, Human
uggguacuaagcuuaacaccugggugaugaaa

SEQ ID NO: 525749 - RNA, 32 nt, Human
uggguagaaagagauacagaggggcuguugaa

SEQ ID NO: 525750 - RNA, 32 nt, Human
uggguagaagaagcugggcaugggugcacccc

SEQ ID NO: 525751 - RNA, 32 nt, Human
uggguagaaguuggagaggaauccuggaauuu

SEQ ID NO: 525752 - RNA, 32 nt, Human
uggguagaauagguuuuccccucuuuuguuaa

SEQ ID NO: 525753 - RNA, 32 nt, Human
uggguagacugcugccggggaaucguacuucu

SEQ ID NO: 525754 - RNA, 32 nt, Human
uggguagagacaccuggaugacauuucaguac

SEQ ID NO: 525755 - RNA, 32 nt, Human
uggguagagacagggucccuuuguugcccagg

SEQ ID NO: 525756 - RNA, 32 nt, Human
uggguagagccaucccuucuucauccauagug

SEQ ID NO: 525757 - RNA, 32 nt, Human
uggguagaggcagagaugcugcugggcauccu

SEQ ID NO: 525758 - RNA, 32 nt, Human
uggguagaggcugcccgaaguacuguguaaag

SEQ ID NO: 525759 - RNA, 32 nt, Human
uggguagaggguccaccucacuugccugagug

SEQ ID NO: 525760 - RNA, 32 nt, Human
uggguagagguagaaagguuuaauuaacccug

SEQ ID NO: 525761 - RNA, 32 nt, Human
uggguagauaguagugggauugcuggaucaaa

SEQ ID NO: 525762 - RNA, 32 nt, Human
uggguagcaguggauguugggauauucuuucc

SEQ ID NO: 525763 - RNA, 32 nt, Human
uggguagcaucuguuucucucagcuuugccuu

SEQ ID NO: 525764 - RNA, 20 nt, Human
uggguagcauuacauuggca

SEQ ID NO: 525765 - RNA, 32 nt, Human
uggguagcgugaggacccacggggcugagcag

SEQ ID NO: 525766 - RNA, 32 nt, Human
uggguagcuuggcugccuccagaagagaugca

SEQ ID NO: 525767 - RNA, 32 nt, Human
uggguaggaaaagauguauguugcuauccugc

SEQ ID NO: 525768 - RNA, 32 nt, Human
uggguaggauuccucuggcacggagggagaga

SEQ ID NO: 525769 - RNA, 32 nt, Human
uggguaggcacaugauagggguugucacaagu

SEQ ID NO: 525770 - RNA, 32 nt, Human
uggguagggaaagaaaggagggaaaaaccaua

SEQ ID NO: 525771 - RNA, 32 nt, Human
uggguagggguuucagccccacccucaggaag

SEQ ID NO: 525772 - RNA, 32 nt, Human
uggguagguuccaguugaaagagggugguaga

SEQ ID NO: 525773 - RNA, 32 nt, Human
uggguagugggaggugggagggaagggcuuug

SEQ ID NO: 525774 - RNA, 32 nt, Human
uggguaguggggaaugaaggggacuggcaugu

SEQ ID NO: 525775 - RNA, 32 nt, Human
uggguauaagcagagagggauggguuccugcu

SEQ ID NO: 525776 - RNA, 32 nt, Human
uggguaucaagcaaaucugaccacaucaccuc

SEQ ID NO: 525777 - RNA, 32 nt, Human
uggguaucauagggagaccccgucucuacaaa

SEQ ID NO: 525778 - RNA, 32 nt, Human
uggguauccagggaggcucugcagcccugcug

SEQ ID NO: 525779 - RNA, 23 nt, Human
uggguauccaggggucucugaug

SEQ ID NO: 525780 - RNA, 32 nt, Human
uggguaugagagacugaggcuugagugaacug

SEQ ID NO: 525781 - RNA, 32 nt, Human
uggguaugcugaggcccacagacuuacagaag

SEQ ID NO: 525782 - RNA, 32 nt, Human
uggguauggugauguuggcaaaugauuaagcc

SEQ ID NO: 525783 - RNA, 24 nt, Human
uggguaugguggcacgugccugug

SEQ ID NO: 525784 - RNA, 24 nt, Human
uggguaugguggcaugugccugua

SEQ ID NO: 525785 - RNA, 24 nt, Human
uggguaugguggcuuaugccugua

SEQ ID NO: 525786 - RNA, 32 nt, Human
uggguauucuaggagcuuggacacgggauugc

SEQ ID NO: 525787 - RNA, 32 nt, Human
uggguauuugcugccaaggccacaucaccaau

SEQ ID NO: 525788 - RNA, 32 nt, Human
uggguauuuucaagaugguguggagggagaua

SEQ ID NO: 525789 - RNA, 32 nt, Human
uggguauuuuugguuuauaugcccucaaguaa

SEQ ID NO: 525790 - RNA, 32 nt, Human
ugggucaaaauggggagauguacuggguauga

SEQ ID NO: 525791 - RNA, 32 nt, Human
ugggucaaaccucccugcuccaggcaugaaga

SEQ ID NO: 525792 - RNA, 32 nt, Human
ugggucaaacuaaaauuagaaauguccccuca

SEQ ID NO: 525793 - RNA, 32 nt, Human
ugggucaaaggauggacaaaccuugaggguua

SEQ ID NO: 525794 - RNA, 32 nt, Human
ugggucaaauuugagauauaaaaaccuuucuc

SEQ ID NO: 525795 - RNA, 32 nt, Human
ugggucaaggcaccugccuguuuuuguuggug

SEQ ID NO: 525796 - RNA, 32 nt, Human
ugggucaaugaccauugcagagcuguuccugu

SEQ ID NO: 525797 - RNA, 32 nt, Human
ugggucaaugccuucagaaauggaauccagug

SEQ ID NO: 525798 - RNA, 32 nt, Human
ugggucaccagcugcccaaggugccggccugc

SEQ ID NO: 525799 - RNA, 32 nt, Human
ugggucacccuguccuggaugccucugaagag

SEQ ID NO: 525800 - RNA, 21 nt, Human
ugggucacgccuguaauccca

SEQ ID NO: 525801 - RNA, 32 nt, Human
ugggucacgccuguaaucccagcacuuuggga

SEQ ID NO: 525802 - RNA, 32 nt, Human
ugggucacugcaaacuccgccucccagguuca

SEQ ID NO: 525803 - RNA, 32 nt, Human
ugggucacugcaaccucugccuccuggguuca

SEQ ID NO: 525804 - RNA, 32 nt, Human
ugggucagaaggagccucauccuaaucucacu

SEQ ID NO: 525805 - RNA, 32 nt, Human
ugggucagccuccccuccaccacuuccuuccc

SEQ ID NO: 525806 - RNA, 32 nt, Human
ugggucaggaaagagaaagcaggaagaaaauc

SEQ ID NO: 525807 - RNA, 32 nt, Human
ugggucaggaguuugagaccagccuggccaac

SEQ ID NO: 525808 - RNA, 32 nt, Human
ugggucaggcagcuguugugauuguuaguauu

SEQ ID NO: 525809 - RNA, 32 nt, Human
ugggucaggcgcuuguggagagagggcuucgc

SEQ ID NO: 525810 - RNA, 32 nt, Human
ugggucagggcuucacuguguugcccaggcua

SEQ ID NO: 525811 - RNA, 32 nt, Human
ugggucaggguggggcaacaguggcaucaggu

SEQ ID NO: 525812 - RNA, 32 nt, Human
ugggucaguuguaucagcacguguggccuguu

SEQ ID NO: 525813 - RNA, 32 nt, Human
ugggucaguuuggccauaauucuggggucagg

SEQ ID NO: 525814 - RNA, 32 nt, Human
ugggucaugagccaugaguccugggacaucug

SEQ ID NO: 525815 - RNA, 28 nt, Human
ugggucauguuuacaguccucagugccc

SEQ ID NO: 525816 - RNA, 32 nt, Human
ugggucauuguagccucaaccucccaggcucc

SEQ ID NO: 525817 - RNA, 32 nt, Human
ugggucauuuuccugacucuagcugccaaaug

SEQ ID NO: 525818 - RNA, 32 nt, Human
uggguccaaauuguuggcuuucacuuuugacc

SEQ ID NO: 525819 - RNA, 32 nt, Human
uggguccaaggcccuggcccugcccagccucu

SEQ ID NO: 525820 - RNA, 32 nt, Human
uggguccacguuccucugcccuggguggggua

SEQ ID NO: 525821 - RNA, 32 nt, Human
uggguccagaagccucucagccaggagggagc

SEQ ID NO: 525822 - RNA, 32 nt, Human
uggguccagcagagagcuggcugggggcuuga

SEQ ID NO: 525823 - RNA, 32 nt, Human
uggguccagcagagggaguggaggaagggcca

SEQ ID NO: 525824 - RNA, 32 nt, Human
uggguccagcugcccaggucauggccuaccuc

SEQ ID NO: 525825 - RNA, 32 nt, Human
uggguccagcuuggccuuuucuucccagggac

SEQ ID NO: 525826 - RNA, 32 nt, Human
uggguccaggagguggaggcugcagugagcua

SEQ ID NO: 525827 - RNA, 32 nt, Human
uggguccaguggaggaagaaggaaggagaggc

SEQ ID NO: 525828 - RNA, 32 nt, Human
uggguccaucagagaaggugcaggugacagag

SEQ ID NO: 525829 - RNA, 32 nt, Human
uggguccaucuugcugcucagaagaaucccgu

SEQ ID NO: 525830 - RNA, 32 nt, Human
ugggucccacccuuuaaggaugcugaggccua

SEQ ID NO: 525831 - RNA, 32 nt, Human
ugggucccagagaguuuggaguguaggauucc

SEQ ID NO: 525832 - RNA, 32 nt, Human
ugggucccagcaccuaucucaggaagcagggu

SEQ ID NO: 525833 - RNA, 22 nt, Human
ugggucccaggcccauagcugc

SEQ ID NO: 525834 - RNA, 21 nt, Human
ugggucccauuuucagcgccc

SEQ ID NO: 525835 - RNA, 32 nt, Human
uggguccccaggaggagagccuuggguauaau

SEQ ID NO: 525836 - RNA, 32 nt, Human
uggguccccagugcccucagccccgcagcgua

SEQ ID NO: 525837 - RNA, 32 nt, Human
uggguccccaugccucuccagcaugcccuuuc

SEQ ID NO: 525838 - RNA, 19 nt, Human
uggguccccgcccuccagc

SEQ ID NO: 525839 - RNA, 21 nt, Human
uggguccccgccgcgcccgcu

SEQ ID NO: 525840 - RNA, 27 nt, Human
uggguccccuguuuccggagguccgcu

SEQ ID NO: 525841 - RNA, 32 nt, Human
ugggucccgggagauggaagccucccaggcgc

SEQ ID NO: 525842 - RNA, 32 nt, Human
ugggucccguaaaggagggcacgagggccacc

SEQ ID NO: 525843 - RNA, 32 nt, Human
ugggucccuaaccuauaaucucagcuucccua

SEQ ID NO: 525844 - RNA, 32 nt, Human
ugggucccucuaacaucucccauggcucuccc

SEQ ID NO: 525845 - RNA, 32 nt, Human
ugggucccucuccugcuggguggugcuuucuc

SEQ ID NO: 525846 - RNA, 32 nt, Human
ugggucccugcuccccuuugggggugugugug

SEQ ID NO: 525847 - RNA, 32 nt, Human
ugggucccuuaaaggagggcacgagggccacc

SEQ ID NO: 525848 - RNA, 32 nt, Human
ugggucccuugugacugcauuacacugagaaa

SEQ ID NO: 525849 - RNA, 32 nt, Human
uggguccgauuagccuuuucucugccuugcuu

SEQ ID NO: 525850 - RNA, 32 nt, Human
uggguccgcggcccuggcugggccacggcgcu

SEQ ID NO: 525851 - RNA, 32 nt, Human
uggguccggccugccugccugccugccugccu

SEQ ID NO: 525852 - RNA, 24 nt, Human
uggguccgguggcucacgccugua

SEQ ID NO: 525853 - RNA, 24 nt, Human
uggguccuaaauccaaccaacuac

SEQ ID NO: 525854 - RNA, 32 nt, Human
uggguccuccccucugagguuucucagguggc

SEQ ID NO: 525855 - RNA, 32 nt, Human
uggguccuccucccucugccucuguucagcuc

SEQ ID NO: 525856 - RNA, 32 nt, Human
uggguccucuucagaggccagaaaguucuaag

SEQ ID NO: 525857 - RNA, 32 nt, Human
uggguccugaggcacagcucugagcacagagg

SEQ ID NO: 525858 - RNA, 32 nt, Human
uggguccugagggagagcugcagugagaaguu

SEQ ID NO: 525859 - RNA, 32 nt, Human
uggguccugcacgccgccugguggcaggccgg

SEQ ID NO: 525860 - RNA, 32 nt, Human
uggguccugccucugccuggcagcucuguggg

SEQ ID NO: 525861 - RNA, 21 nt, Human
uggguccuggcgauuauuuua

SEQ ID NO: 525862 - RNA, 32 nt, Human
uggguccuggggagccacggaagguugugggu

SEQ ID NO: 525863 - RNA, 23 nt, Human
uggguccuggggccacagaccac

SEQ ID NO: 525864 - RNA, 32 nt, Human
uggguccuguuuuugucauguuuaugaggaga

SEQ ID NO: 525865 - RNA, 32 nt, Human
uggguccuucccauuacgcacacacauaaugu

SEQ ID NO: 525866 - RNA, 32 nt, Human
uggguccuuggggcgggcagggccagccucuc

SEQ ID NO: 525867 - RNA, 32 nt, Human
uggguccuugggucgcaggugggagccgacgg

SEQ ID NO: 525868 - RNA, 32 nt, Human
ugggucgaguuuaggccuuuuuggccauaguu

SEQ ID NO: 525869 - RNA, 32 nt, Human
ugggucgcaggugggagccgacggguggguag

SEQ ID NO: 525870 - RNA, 32 nt, Human
ugggucgcugcagccucaaccuccugggcuca

SEQ ID NO: 525871 - RNA, 32 nt, Human
ugggucgcuguugccagaccugcacccccaag

SEQ ID NO: 525872 - RNA, 32 nt, Human
ugggucggagccaaaccccacaggaaugcagc

SEQ ID NO: 525873 - RNA, 32 nt, Human
ugggucgguggcggaggcugaggagaaggagg

SEQ ID NO: 525874 - RNA, 32 nt, Human
ugggucgucaggagguggagguugcagugagc

SEQ ID NO: 525875 - RNA, 32 nt, Human
ugggucguccuugucuguagaagugaauacug

SEQ ID NO: 525876 - RNA, 32 nt, Human
ugggucgugagcucgccugaguaugggguggu

SEQ ID NO: 525877 - RNA, 32 nt, Human
ugggucguucuugucuguagaagugaauacug

SEQ ID NO: 525878 - RNA, 32 nt, Human
ugggucuaacccagaaccacagauggcucuga

SEQ ID NO: 525879 - RNA, 32 nt, Human
ugggucuagauugagggauacucccccuuucc

SEQ ID NO: 525880 - RNA, 32 nt, Human
ugggucuagcacaugucacccuuguccacguu

SEQ ID NO: 525881 - RNA, 32 nt, Human
ugggucuauuagccucuccccagauaucugag

SEQ ID NO: 525882 - RNA, 31 nt, Human
ugggucucaauucauuuacuguugaacacgg

SEQ ID NO: 525883 - RNA, 32 nt, Human
ugggucucagccacguacaaccucacggugga

SEQ ID NO: 525884 - RNA, 32 nt, Human
ugggucucaguuuuccccaucuggacccuugc

SEQ ID NO: 525885 - RNA, 22 nt, Human
ugggucucaugguuucauuuug

SEQ ID NO: 525886 - RNA, 32 nt, Human
ugggucuccacuacccagucacugacccuggg

SEQ ID NO: 525887 - RNA, 32 nt, Human
ugggucuccagcucuguaaccaguccuguccc

SEQ ID NO: 525888 - RNA, 32 nt, Human
ugggucucccgaguggcugggauuauaggcgu

SEQ ID NO: 525889 - RNA, 22 nt, Human
ugggucuccgcccagcuccagu

SEQ ID NO: 525890 - RNA, 21 nt, Human
ugggucuccguuucucuagcu

SEQ ID NO: 525891 - RNA, 32 nt, Human
ugggucuccuaaaguacugggauuacaggcgu

SEQ ID NO: 525892 - RNA, 22 nt, Human
ugggucucuagccucagucuug

SEQ ID NO: 525893 - RNA, 32 nt, Human
ugggucucuauuaauagauuuacccuuuauag

SEQ ID NO: 525894 - RNA, 32 nt, Human
ugggucucuccaagcagcugcagaccccagcu

SEQ ID NO: 525895 - RNA, 32 nt, Human
ugggucucucugcuguggcguucucucuugag

SEQ ID NO: 525896 - RNA, 32 nt, Human
ugggucucugcaggccugcucaccugccucca

SEQ ID NO: 525897 - RNA, 32 nt, Human
ugggucucuggaagaggaaccaggagaagggc

SEQ ID NO: 525898 - RNA, 32 nt, Human
ugggucucuggccuugcccugaaauuacuggg

SEQ ID NO: 525899 - RNA, 32 nt, Human
ugggucucugggagaggaaggaagagggaggg

SEQ ID NO: 525900 - RNA, 32 nt, Human
ugggucugaaacacuggcagucguuggaaaca

SEQ ID NO: 525901 - RNA, 32 nt, Human
ugggucugacucacccacaauccaucagccug

SEQ ID NO: 525902 - RNA, 32 nt, Human
ugggucugauccuagagacagaaaguugacug

SEQ ID NO: 525903 - RNA, 32 nt, Human
ugggucugcagccaugguuuggguggcuguag

SEQ ID NO: 525904 - RNA, 32 nt, Human
ugggucugcccugagcugugccugugugcucc

SEQ ID NO: 525905 - RNA, 32 nt, Human
ugggucugccuagucaugccucccaacugugg

SEQ ID NO: 525906 - RNA, 32 nt, Human
ugggucugcucagcaccuuccucucuccucca

SEQ ID NO: 525907 - RNA, 32 nt, Human
ugggucuggaggugaugagaucgggccacacu

SEQ ID NO: 525908 - RNA, 32 nt, Human
ugggucuggccuggccgccccuccagccugcu

SEQ ID NO: 525909 - RNA, 32 nt, Human
ugggucuggcucccgucagucuuugggccacg

SEQ ID NO: 525910 - RNA, 29 nt, Human
ugggucuggcugcugccgcccgccggugu

SEQ ID NO: 525911 - RNA, 32 nt, Human
ugggucugggaguggccucacccuggauucag

SEQ ID NO: 525912 - RNA, 32 nt, Human
ugggucugggccaccaggaucagccaggaggg

SEQ ID NO: 525913 - RNA, 32 nt, Human
ugggucuggucucaucagggagggcagcgcuc

SEQ ID NO: 525914 - RNA, 32 nt, Human
ugggucuguccucucagugcuuuccaggggcc

SEQ ID NO: 525915 - RNA, 32 nt, Human
ugggucugucuacacuggccgagucuccgacu

SEQ ID NO: 525916 - RNA, 32 nt, Human
ugggucugugagagcaaagcugaguucugguc

SEQ ID NO: 525917 - RNA, 32 nt, Human
ugggucuguggcugggaggagcucuggggaag

SEQ ID NO: 525918 - RNA, 32 nt, Human
ugggucuguguccuuuuucaagccuguuuaga

SEQ ID NO: 525919 - RNA, 32 nt, Human
ugggucuguuccagucgauucaagaugaacug

SEQ ID NO: 525920 - RNA, 32 nt, Human
ugggucuguuuuccuuucucaccgcagucguc

SEQ ID NO: 525921 - RNA, 32 nt, Human
ugggucuuagcauugaucagugacacaccucu

SEQ ID NO: 525922 - RNA, 32 nt, Human
ugggucuuagggaaaggaauggggaagcaaca

SEQ ID NO: 525923 - RNA, 32 nt, Human
ugggucuuccaagaggauucuuaagguaccag

SEQ ID NO: 525924 - RNA, 32 nt, Human
ugggucuucugaaucuagaguaaguccucugu

SEQ ID NO: 525925 - RNA, 32 nt, Human
ugggucuugcugucacuggauuuccuggcaug

SEQ ID NO: 525926 - RNA, 32 nt, Human
ugggucuuggagaggaaggacuuagggaggca

SEQ ID NO: 525927 - RNA, 32 nt, Human
ugggucuuggauacacaguuguauuuaauguu

SEQ ID NO: 525928 - RNA, 32 nt, Human
ugggucuuucccaccugccuguuuucauaucc

SEQ ID NO: 525929 - RNA, 32 nt, Human
ugggugaaaaguacuguucagagaugcaggug

SEQ ID NO: 525930 - RNA, 32 nt, Human
ugggugaacagcuuggccuuuugugggugucu

SEQ ID NO: 525931 - RNA, 32 nt, Human
ugggugaacauguaaacgcuaaguugaaaauc

SEQ ID NO: 525932 - RNA, 32 nt, Human
ugggugaagucagaacuuuguagagcagagaa

SEQ ID NO: 525933 - RNA, 17 nt, Human
ugggugaaugaugggga

SEQ ID NO: 525934 - RNA, 32 nt, Human
ugggugaaugcugcugccccugcuggcagcca

SEQ ID NO: 525935 - RNA, 32 nt, Human
ugggugacaaugcacacaugcugggcaaaagg

SEQ ID NO: 525936 - RNA, 32 nt, Human
ugggugacacgaggacacagggacagguucua

SEQ ID NO: 525937 - RNA, 32 nt, Human
ugggugacagagccaugagccagccauuuuau

SEQ ID NO: 525938 - RNA, 31 nt, Human
ugggugacagccucagaguguuucuucugcu

SEQ ID NO: 525939 - RNA, 32 nt, Human
ugggugacauauguaaucccagcacuuuggga

SEQ ID NO: 525940 - RNA, 32 nt, Human
ugggugacgaggccacccagagccaggcggug

SEQ ID NO: 525941 - RNA, 32 nt, Human
ugggugacguccaggucacaggcugcagcgag

SEQ ID NO: 525942 - RNA, 32 nt, Human
ugggugagaagagggaaaauugcagggaccuc

SEQ ID NO: 525943 - RNA, 32 nt, Human
ugggugagagaagggacuagacuccuaagccu

SEQ ID NO: 525944 - RNA, 32 nt, Human
ugggugagagagcagguaagagccaaagucac

SEQ ID NO: 525945 - RNA, 32 nt, Human
ugggugagauguguguuaaaacugacaaaccu

SEQ ID NO: 525946 - RNA, 32 nt, Human
ugggugagcgccaccagccugcagcccagcag

SEQ ID NO: 525947 - RNA, 32 nt, Human
ugggugagcugaaagagagggacuagagugcc

SEQ ID NO: 525948 - RNA, 32 nt, Human
ugggugaggaggccccgcugaagaacucgccu

SEQ ID NO: 525949 - RNA, 32 nt, Human
ugggugaggggcagauuucugccccuuugucc

SEQ ID NO: 525950 - RNA, 18 nt, Human
ugggugaggggggccgga

SEQ ID NO: 525951 - RNA, 32 nt, Human
ugggugagguuuuccaugacugccucaucagc

SEQ ID NO: 525952 - RNA, 32 nt, Human
ugggugagucgugugacucaggaaugggggua

SEQ ID NO: 525953 - RNA, 32 nt, Human
ugggugagucuguggccuucucuccagggccc

SEQ ID NO: 525954 - RNA, 32 nt, Human
ugggugauaggaugagacuccaucucagggga

SEQ ID NO: 525955 - RNA, 32 nt, Human
ugggugaucagaaggcuggggccaguguaagg

SEQ ID NO: 525956 - RNA, 32 nt, Human
ugggugaugacaggggaaucugaaaggggaga

SEQ ID NO: 525957 - RNA, 31 nt, Human
ugggugaugcucaugguaaacucgcucacag

SEQ ID NO: 525958 - RNA, 31 nt, Human
ugggugauggagagagauacugucuuaaaaa

SEQ ID NO: 525959 - RNA, 32 nt, Human
ugggugauggagcgaagaaccugucucuuaaa

SEQ ID NO: 525960 - RNA, 32 nt, Human
ugggugauggauccuggaaucucuccaucccu

SEQ ID NO: 525961 - RNA, 32 nt, Human
ugggugauggugguuguuagucugacuguugc

SEQ ID NO: 525962 - RNA, 32 nt, Human
ugggugauguuggacaacuggaaggaggacuc

SEQ ID NO: 525963 - RNA, 31 nt, Human
ugggugauucuucucccuccaagccaagcuu

SEQ ID NO: 525964 - RNA, 24 nt, Human
ugggugcagaggcucaugccugua

SEQ ID NO: 525965 - RNA, 32 nt, Human
ugggugcagcagagacagaggaagcagagcca

SEQ ID NO: 525966 - RNA, 32 nt, Human
ugggugcagccuggcuguugcucacccaagug

SEQ ID NO: 525967 - RNA, 32 nt, Human
ugggugcagcgugaggcuucagccuggagccc

SEQ ID NO: 525968 - RNA, 24 nt, Human
ugggugcaguggcucacaccggua

SEQ ID NO: 525969 - RNA, 21 nt, Human
ugggugcaguggcucacaccu

SEQ ID NO: 525970 - RNA, 24 nt, Human
ugggugcaguggcucacaccugua

SEQ ID NO: 525971 - RNA, 24 nt, Human
ugggugcaguggcucacaccugug

SEQ ID NO: 525972 - RNA, 24 nt, Human
ugggugcaguggcucacacuugua

SEQ ID NO: 525973 - RNA, 24 nt, Human
ugggugcaguggcucacaucugua

SEQ ID NO: 525974 - RNA, 24 nt, Human
ugggugcaguggcucacgccugua

SEQ ID NO: 525975 - RNA, 24 nt, Human
ugggugcaguggcucacuccugua

SEQ ID NO: 525976 - RNA, 24 nt, Human
ugggugcaguggcucaggccugua

SEQ ID NO: 525977 - RNA, 21 nt, Human
ugggugcaguggcucaugccu

SEQ ID NO: 525978 - RNA, 24 nt, Human
ugggugcaguggcucaugccugua

SEQ ID NO: 525979 - RNA, 24 nt, Human
ugggugcaguggcucuugccugua

SEQ ID NO: 525980 - RNA, 24 nt, Human
ugggugcagugguauauaccugua

SEQ ID NO: 525981 - RNA, 24 nt, Human
ugggugcaguggugcaugccugua

SEQ ID NO: 525982 - RNA, 26 nt, Human
ugggugcaguggugcgcaugccugua

SEQ ID NO: 525983 - RNA, 24 nt, Human
ugggugcagugguucacaccugua

SEQ ID NO: 525984 - RNA, 32 nt, Human
ugggugcauggagccccaguagacagaaagug

SEQ ID NO: 525985 - RNA, 32 nt, Human
ugggugcaugugggaacucuucuuuagggcuu

SEQ ID NO: 525986 - RNA, 32 nt, Human
ugggugccaccuggacuccacucuccccucuc

SEQ ID NO: 525987 - RNA, 32 nt, Human
ugggugccagagaggcggaagaggaggccuga

SEQ ID NO: 525988 - RNA, 32 nt, Human
ugggugccagcccucaguguggcuuugugauu

SEQ ID NO: 525989 - RNA, 23 nt, Human
ugggugccagcucagcagccccc

SEQ ID NO: 525990 - RNA, 20 nt, Human
ugggugccauuugagcccag

SEQ ID NO: 525991 - RNA, 21 nt, Human
ugggugcccaaguucacggag

SEQ ID NO: 525992 - RNA, 22 nt, Human
ugggugccccaggaccacagga

SEQ ID NO: 525993 - RNA, 32 nt, Human
ugggugccccugaccccuuggcaccggauaca

SEQ ID NO: 525994 - RNA, 32 nt, Human
ugggugcccggccuggaacacagguucugucu

SEQ ID NO: 525995 - RNA, 24 nt, Human
ugggugccguggcucacaccugua

SEQ ID NO: 525996 - RNA, 24 nt, Human
ugggugccguggcucacgccugua

SEQ ID NO: 525997 - RNA, 31 nt, Human
ugggugccuaucugggccacaagugagucaa

SEQ ID NO: 525998 - RNA, 32 nt, Human
ugggugccuccugcaguuugggagacauggac

SEQ ID NO: 525999 - RNA, 32 nt, Human
ugggugccugaauucaugcgugucagucaccc

SEQ ID NO: 526000 - RNA, 18 nt, Human
ugggugccuguaauccca

SEQ ID NO: 526001 - RNA, 32 nt, Human
ugggugccuguaaucccagcuacuugggaagc

SEQ ID NO: 526002 - RNA, 32 nt, Human
ugggugccuguaaucccagcuacuugggaggc

SEQ ID NO: 526003 - RNA, 32 nt, Human
ugggugccuguaaucccaguuacuugggaggc

SEQ ID NO: 526004 - RNA, 32 nt, Human
ugggugccuguaauccuagcuacuugggaggc

SEQ ID NO: 526005 - RNA, 20 nt, Human
ugggugccugugaagccugg

SEQ ID NO: 526006 - RNA, 32 nt, Human
ugggugccugugguuggagcuguggagguguc

SEQ ID NO: 526007 - RNA, 32 nt, Human
ugggugccuugcuuuguucuucccaagcuguu

SEQ ID NO: 526008 - RNA, 32 nt, Human
ugggugcgcagccggcccugcgcccgcgacgc

SEQ ID NO: 526009 - RNA, 26 nt, Human
ugggugcgcuguggcucaugccugua

SEQ ID NO: 526010 - RNA, 32 nt, Human
ugggugcggauccagcggacgaaucccgaggc

SEQ ID NO: 526011 - RNA, 24 nt, Human
ugggugcggugacucaugccugua

SEQ ID NO: 526012 - RNA, 24 nt, Human
ugggugcgguggcacaugccugua

SEQ ID NO: 526013 - RNA, 24 nt, Human
ugggugcgguggcaggugccugua

SEQ ID NO: 526014 - RNA, 23 nt, Human
ugggugcgguggcucacaccugu

SEQ ID NO: 526015 - RNA, 24 nt, Human
ugggugcgguggcucacaccugua

SEQ ID NO: 526016 - RNA, 24 nt, Human
ugggugcgguggcucacgccugua

SEQ ID NO: 526017 - RNA, 24 nt, Human
ugggugcgguggcucacgcuugua

SEQ ID NO: 526018 - RNA, 24 nt, Human
ugggugcgguggcucacgucugua

SEQ ID NO: 526019 - RNA, 24 nt, Human
ugggugcgguggcucaugcacgua

SEQ ID NO: 526020 - RNA, 24 nt, Human
ugggugcgguggcucaugccugua

SEQ ID NO: 526021 - RNA, 24 nt, Human
ugggugcgguggcucaugccugug

SEQ ID NO: 526022 - RNA, 24 nt, Human
ugggugcgguggcucaugucugua

SEQ ID NO: 526023 - RNA, 24 nt, Human
ugggugcgguggcuuacaccugua

SEQ ID NO: 526024 - RNA, 21 nt, Human
ugggugcggugguucaugccu

SEQ ID NO: 526025 - RNA, 32 nt, Human
ugggugcgucccaucuccccagcuugcugcuc

SEQ ID NO: 526026 - RNA, 32 nt, Human
ugggugcuccugggaugggaccagccuccucc

SEQ ID NO: 526027 - RNA, 32 nt, Human
ugggugcugcuagaggguguggaaaagaccaa

SEQ ID NO: 526028 - RNA, 32 nt, Human
ugggugcugcuggccuccaagcuggcaguggg

SEQ ID NO: 526029 - RNA, 32 nt, Human
ugggugcugcuugaugugaaugaggucccgca

SEQ ID NO: 526030 - RNA, 32 nt, Human
ugggugcuggagcaggggaggaaagggcuuug

SEQ ID NO: 526031 - RNA, 32 nt, Human
ugggugcuggcuggugggaugggggagggugg

SEQ ID NO: 526032 - RNA, 32 nt, Human
ugggugcugggaaccaggaagagugggggaag

SEQ ID NO: 526033 - RNA, 32 nt, Human
ugggugcugggaagggaggguugaaaccaccg

SEQ ID NO: 526034 - RNA, 32 nt, Human
ugggugcugugcccuagggccuggguggcagg

SEQ ID NO: 526035 - RNA, 22 nt, Human
ugggugcuguggcucacgccug

SEQ ID NO: 526036 - RNA, 24 nt, Human
ugggugcuguggcucacgccugua

SEQ ID NO: 526037 - RNA, 24 nt, Human
ugggugcuguggcucaugccugua

SEQ ID NO: 526038 - RNA, 32 nt, Human
ugggugcuucucucccugcaggcuggccacuc

SEQ ID NO: 526039 - RNA, 32 nt, Human
ugggugcuuguugggccuuuuuccaguaagga

SEQ ID NO: 526040 - RNA, 32 nt, Human
uggguggaagggacccuccucacuggauggug

SEQ ID NO: 526041 - RNA, 32 nt, Human
uggguggacacagcaagaaggcccucaucaga

SEQ ID NO: 526042 - RNA, 32 nt, Human
uggguggagagggaggggauaagagaggugca

SEQ ID NO: 526043 - RNA, 32 nt, Human
uggguggagcaaugugcucuggggagaaagcu

SEQ ID NO: 526044 - RNA, 32 nt, Human
uggguggaggagagaguggcacccucugauug

SEQ ID NO: 526045 - RNA, 32 nt, Human
uggguggaggggcuggggguacacacagcuca

SEQ ID NO: 526046 - RNA, 32 nt, Human
uggguggagggugaguuugaagagguucugau

SEQ ID NO: 526047 - RNA, 24 nt, Human
uggguggaguggcucauaccugua

SEQ ID NO: 526048 - RNA, 23 nt, Human
uggguggaucaccugagaucagg

SEQ ID NO: 526049 - RNA, 23 nt, Human
uggguggaucaccugagcucagg

SEQ ID NO: 526050 - RNA, 23 nt, Human
uggguggaucaccugaggucagg

SEQ ID NO: 526051 - RNA, 23 nt, Human
uggguggaucacuugaagucagg

SEQ ID NO: 526052 - RNA, 23 nt, Human
uggguggaucacuugagcucagg

SEQ ID NO: 526053 - RNA, 18 nt, Human
uggguggaucacuugagg

SEQ ID NO: 526054 - RNA, 23 nt, Human
uggguggaucacuugaggucagg

SEQ ID NO: 526055 - RNA, 32 nt, Human
uggguggaucacuugaguucaggaguucgaga

SEQ ID NO: 526056 - RNA, 32 nt, Human
uggguggaugcagugguccaggacuggggucu

SEQ ID NO: 526057 - RNA, 23 nt, Human
uggguggauuaccugaggucagg

SEQ ID NO: 526058 - RNA, 21 nt, Human
uggguggauuagcuaccccag

SEQ ID NO: 526059 - RNA, 23 nt, Human
uggguggauucuggaaccucagg

SEQ ID NO: 526060 - RNA, 23 nt, Human
uggguggauugcuugagcccagg

SEQ ID NO: 526061 - RNA, 19 nt, Human
uggguggauuuagccaagg

SEQ ID NO: 526062 - RNA, 32 nt, Human
uggguggcaaacuuuuucugcaaaggaucagc

SEQ ID NO: 526063 - RNA, 32 nt, Human
uggguggcaagaacaucuaugcuaguggccac

SEQ ID NO: 526064 - RNA, 32 nt, Human
uggguggcaauuccagcuuagcaacgcagaag

SEQ ID NO: 526065 - RNA, 19 nt, Human
uggguggcacaucccaaga

SEQ ID NO: 526066 - RNA, 17 nt, Human
uggguggcagagccaga

SEQ ID NO: 526067 - RNA, 32 nt, Human
uggguggcaggauaugaaggaagcuguaggca

SEQ ID NO: 526068 - RNA, 31 nt, Human
uggguggcaugucucucucuaccucauuuuu

SEQ ID NO: 526069 - RNA, 32 nt, Human
uggguggccauggaggagcccccugugcgaga

SEQ ID NO: 526070 - RNA, 32 nt, Human
uggguggcccagguccauccugggcagcaaag

SEQ ID NO: 526071 - RNA, 32 nt, Human
uggguggcccucagguguaacugugucugaga

SEQ ID NO: 526072 - RNA, 18 nt, Human
uggguggccggagccgga

SEQ ID NO: 526073 - RNA, 32 nt, Human
uggguggccuaaguucacagggagguaauggg

SEQ ID NO: 526074 - RNA, 32 nt, Human
uggguggccuaugauggaugggggcucugugg

SEQ ID NO: 526075 - RNA, 32 nt, Human
uggguggccucagggauaggcgcuccccaagg

SEQ ID NO: 526076 - RNA, 32 nt, Human
uggguggccuccaggcucaaugcagaaacccc

SEQ ID NO: 526077 - RNA, 32 nt, Human
uggguggccugcuccccugccugggcccugac

SEQ ID NO: 526078 - RNA, 32 nt, Human
uggguggccugugauggaugggggcucugugg

SEQ ID NO: 526079 - RNA, 19 nt, Human
uggguggcucauacgugua

SEQ ID NO: 526080 - RNA, 18 nt, Human
uggguggcugcuguccac

SEQ ID NO: 526081 - RNA, 32 nt, Human
uggguggcuuaggccuucaaauugagcuuggg

SEQ ID NO: 526082 - RNA, 32 nt, Human
ugggugggaccgggacagaaagacuuacaugg

SEQ ID NO: 526083 - RNA, 32 nt, Human
ugggugggacuaggaacucagcuuccggucca

SEQ ID NO: 526084 - RNA, 32 nt, Human
ugggugggacuugugacccuacccugucaggc

SEQ ID NO: 526085 - RNA, 32 nt, Human
ugggugggagacaaauuuuaccuggcugaucu

SEQ ID NO: 526086 - RNA, 32 nt, Human
ugggugggagagggggagucucacggggcccc

SEQ ID NO: 526087 - RNA, 32 nt, Human
ugggugggaggagcagccgagugaagaagggg

SEQ ID NO: 526088 - RNA, 32 nt, Human
ugggugggaggugagauugauagugcaguaau

SEQ ID NO: 526089 - RNA, 32 nt, Human
ugggugggagugagacuggguagaauguuacu

SEQ ID NO: 526090 - RNA, 18 nt, Human
ugggugggcaaggccagg

SEQ ID NO: 526091 - RNA, 32 nt, Human
ugggugggcacagugggugugccugagcauuc

SEQ ID NO: 526092 - RNA, 32 nt, Human
ugggugggcauuucacgggaaggguugguaug

SEQ ID NO: 526093 - RNA, 32 nt, Human
ugggugggcuauaauccagcacuuuaggaggc

SEQ ID NO: 526094 - RNA, 31 nt, Human
ugggugggcucugagcaccuguugggggcuu

SEQ ID NO: 526095 - RNA, 32 nt, Human
ugggugggcugaguggaggugccugggagcug

SEQ ID NO: 526096 - RNA, 32 nt, Human
uggguggggaaaggaaguggcuuugaggcaca

SEQ ID NO: 526097 - RNA, 32 nt, Human
uggguggggaggaucaauuagagaggaggcac

SEQ ID NO: 526098 - RNA, 32 nt, Human
uggguggggcagaggccaggaggggaccuggu

SEQ ID NO: 526099 - RNA, 32 nt, Human
uggguggggcagccccaagccuccuggggagg

SEQ ID NO: 526100 - RNA, 32 nt, Human
uggguggggcaggaugggugcccacaccccua

SEQ ID NO: 526101 - RNA, 32 nt, Human
uggguggggccaaagaggaggcuucuauugau

SEQ ID NO: 526102 - RNA, 32 nt, Human
uggguggggccugagauucugcauuuuuccca

SEQ ID NO: 526103 - RNA, 32 nt, Human
uggguggggcuggaggagcaggggugcauccc

SEQ ID NO: 526104 - RNA, 32 nt, Human
uggguggggcuggggacacaacaaugacugag

SEQ ID NO: 526105 - RNA, 32 nt, Human
ugggugggggaagucccuccccaaccacuuaa

SEQ ID NO: 526106 - RNA, 32 nt, Human
ugggugggggacagagccagauucagaguaau

SEQ ID NO: 526107 - RNA, 32 nt, Human
ugggugggggagcagguuggagaggggaccaa

SEQ ID NO: 526108 - RNA, 32 nt, Human
ugggugggggcagccuccaccuccuggauuca

SEQ ID NO: 526109 - RNA, 32 nt, Human
ugggugggggcuaccacccacccucucagucu

SEQ ID NO: 526110 - RNA, 32 nt, Human
uggguggggugagccccaggaggaaguuggga

SEQ ID NO: 526111 - RNA, 32 nt, Human
uggguggggugagggccaaaggcuaugguuuc

SEQ ID NO: 526112 - RNA, 32 nt, Human
uggguggggugaggggugagcagccauagaag

SEQ ID NO: 526113 - RNA, 30 nt, Human
uggguggggugccacagggcgggguucagg

SEQ ID NO: 526114 - RNA, 32 nt, Human
ugggugggucggagcccaggaggcagcugggg

SEQ ID NO: 526115 - RNA, 32 nt, Human
ugggugggucugcagaucucacaccacagaca

SEQ ID NO: 526116 - RNA, 32 nt, Human
ugggugggugaggccagaagagacugccuccg

SEQ ID NO: 526117 - RNA, 32 nt, Human
ugggugggugccuggcugugugcagugaggag

SEQ ID NO: 526118 - RNA, 18 nt, Human
uggguggguggacccagg

SEQ ID NO: 526119 - RNA, 32 nt, Human
uggguggguggagggcaggcagguggcugggu

SEQ ID NO: 526120 - RNA, 32 nt, Human
uggguggguggcaggcugggccuagcacuugc

SEQ ID NO: 526121 - RNA, 32 nt, Human
ugggugguagguguggggagagcugcugaaac

SEQ ID NO: 526122 - RNA, 32 nt, Human
ugggugguccaguuuggacugaugggaaucuu

SEQ ID NO: 526123 - RNA, 32 nt, Human
uggguggugagauguggacucugauccuuaau

SEQ ID NO: 526124 - RNA, 32 nt, Human
uggguggugccugugccugacacuccugcccu

SEQ ID NO: 526125 - RNA, 32 nt, Human
ugggugguggaggugggcaguggcaccaugac

SEQ ID NO: 526126 - RNA, 32 nt, Human
ugggugguggccaggugacauuuucugugcgu

SEQ ID NO: 526127 - RNA, 32 nt, Human
uggguggugggaugggagaccauccucagccc

SEQ ID NO: 526128 - RNA, 32 nt, Human
uggguggugggugggguggggugggcauggaa

SEQ ID NO: 526129 - RNA, 32 nt, Human
ugggugguguuucugugcagacaugcuggguc

SEQ ID NO: 526130 - RNA, 32 nt, Human
ugggugguuaagggagugggacccuggcuugc

SEQ ID NO: 526131 - RNA, 32 nt, Human
ugggugguugucuauuugucugucuucagucu

SEQ ID NO: 526132 - RNA, 24 nt, Human
uggguguaacggcggaugccugua

SEQ ID NO: 526133 - RNA, 32 nt, Human
uggguguaauaggggauuagccccagaaggga

SEQ ID NO: 526134 - RNA, 32 nt, Human
uggguguaaugccagguggaaugguuucaaca

SEQ ID NO: 526135 - RNA, 32 nt, Human
uggguguacugagucccugaaucuuuuggccc

SEQ ID NO: 526136 - RNA, 32 nt, Human
uggguguagcagaaaaaggcugugcugcccug

SEQ ID NO: 526137 - RNA, 24 nt, Human
uggguguaguggcgggugccugua

SEQ ID NO: 526138 - RNA, 32 nt, Human
uggguguauacagccccucccccacauacaca

SEQ ID NO: 526139 - RNA, 32 nt, Human
uggguguauaccagggacagguguugcugugc

SEQ ID NO: 526140 - RNA, 32 nt, Human
ugggugucaaugcuuauuagguauccagccgg

SEQ ID NO: 526141 - RNA, 32 nt, Human
ugggugucacccucagcuucucaggccugcag

SEQ ID NO: 526142 - RNA, 32 nt, Human
ugggugucaggcugggguuagugagcagguua

SEQ ID NO: 526143 - RNA, 32 nt, Human
ugggugucaucagccccugccucccaggccag

SEQ ID NO: 526144 - RNA, 32 nt, Human
uggguguccaggccauggggcagcccugggcg

SEQ ID NO: 526145 - RNA, 32 nt, Human
uggguguccccucauccccaguagccucuuuc

SEQ ID NO: 526146 - RNA, 22 nt, Human
ugggugucccuggcucugugag

SEQ ID NO: 526147 - RNA, 32 nt, Human
uggguguccucaacagugaauucacugucugc

SEQ ID NO: 526148 - RNA, 32 nt, Human
uggguguccucccagggagcuucucuucucaa

SEQ ID NO: 526149 - RNA, 32 nt, Human
ugggugucucagguucuguguguccuugugug

SEQ ID NO: 526150 - RNA, 32 nt, Human
ugggugucucuagccucaaagauggccagcug

SEQ ID NO: 526151 - RNA, 32 nt, Human
ugggugucugggaacugccucccucaucugug

SEQ ID NO: 526152 - RNA, 32 nt, Human
ugggugucuuaggaugaugguuaggaacauug

SEQ ID NO: 526153 - RNA, 32 nt, Human
ugggugugacaucagaguauuugaccugcagu

SEQ ID NO: 526154 - RNA, 32 nt, Human
ugggugugagccaccaccagucaacaaaauac

SEQ ID NO: 526155 - RNA, 32 nt, Human
ugggugugagccaccgcgccuggccuauacau

SEQ ID NO: 526156 - RNA, 32 nt, Human
ugggugugagccacugucaugccuggccucgu

SEQ ID NO: 526157 - RNA, 32 nt, Human
ugggugugagccagccgcguggcccugggcaa

SEQ ID NO: 526158 - RNA, 24 nt, Human
ugggugugaugauacaugccugua

SEQ ID NO: 526159 - RNA, 24 nt, Human
ugggugugauggcucacgccugua

SEQ ID NO: 526160 - RNA, 20 nt, Human
ugggugugauggcucaugcc

SEQ ID NO: 526161 - RNA, 24 nt, Human
ugggugugaugguggcucagaccu

SEQ ID NO: 526162 - RNA, 32 nt, Human
ugggugugcuuggcccacagggccugguggug

SEQ ID NO: 526163 - RNA, 24 nt, Human
uggguguggaggcucacaccugua

SEQ ID NO: 526164 - RNA, 22 nt, Human
uggguguggcaguggaccugug

SEQ ID NO: 526165 - RNA, 32 nt, Human
uggguguggccaaaaacaauuuucuuuauucu

SEQ ID NO: 526166 - RNA, 21 nt, Human
uggguguggcggcucaugccu

SEQ ID NO: 526167 - RNA, 32 nt, Human
ugggugugggcccuuauugcagcugucucaca

SEQ ID NO: 526168 - RNA, 24 nt, Human
ugggugugggggugcacaccugua

SEQ ID NO: 526169 - RNA, 32 nt, Human
uggguguggggucgcgcauuuucuucaaccag

SEQ ID NO: 526170 - RNA, 31 nt, Human
uggguguggguggaagggcugggugucgaaa

SEQ ID NO: 526171 - RNA, 32 nt, Human
ugggugugguaccaaggcccuggcucugggca

SEQ ID NO: 526172 - RNA, 24 nt, Human
ugggugugguagcacgcacccgua

SEQ ID NO: 526173 - RNA, 24 nt, Human
ugggugugguagcucguggcugua

SEQ ID NO: 526174 - RNA, 24 nt, Human
uggguguggugacacgcaccugua

SEQ ID NO: 526175 - RNA, 24 nt, Human
uggguguggugacgcuugccugua

SEQ ID NO: 526176 - RNA, 32 nt, Human
uggguguggugagggaggggacauauccuagg

SEQ ID NO: 526177 - RNA, 21 nt, Human
uggguguggugauucagccug

SEQ ID NO: 526178 - RNA, 24 nt, Human
uggguguggugccacaugccugua

SEQ ID NO: 526179 - RNA, 24 nt, Human
ugggugugguggcacacacccgua

SEQ ID NO: 526180 - RNA, 24 nt, Human
ugggugugguggcacacaccugua

SEQ ID NO: 526181 - RNA, 24 nt, Human
ugggugugguggcacacaccugug

SEQ ID NO: 526182 - RNA, 24 nt, Human
ugggugugguggcacacgccugua

SEQ ID NO: 526183 - RNA, 20 nt, Human
ugggugugguggcacaugcc

SEQ ID NO: 526184 - RNA, 24 nt, Human
ugggugugguggcacaugccugua

SEQ ID NO: 526185 - RNA, 24 nt, Human
ugggugugguggcacgcaccugua

SEQ ID NO: 526186 - RNA, 23 nt, Human
ugggugugguggcacgugccugu

SEQ ID NO: 526187 - RNA, 24 nt, Human
ugggugugguggcacgugccugua

SEQ ID NO: 526188 - RNA, 24 nt, Human
ugggugugguggcacgugccugug

SEQ ID NO: 526189 - RNA, 24 nt, Human
ugggugugguggcacucaccugua

SEQ ID NO: 526190 - RNA, 24 nt, Human
ugggugugguggcagacagcugua

SEQ ID NO: 526191 - RNA, 24 nt, Human
ugggugugguggcagaggccugua

SEQ ID NO: 526192 - RNA, 24 nt, Human
ugggugugguggcaggagccugua

SEQ ID NO: 526193 - RNA, 24 nt, Human
ugggugugguggcagucaccugua

SEQ ID NO: 526194 - RNA, 24 nt, Human
ugggugugguggcauacgccugua

SEQ ID NO: 526195 - RNA, 24 nt, Human
ugggugugguggcaugcaccugua

SEQ ID NO: 526196 - RNA, 24 nt, Human
ugggugugguggcaugcgcaugua

SEQ ID NO: 526197 - RNA, 24 nt, Human
ugggugugguggcaugcgccugua

SEQ ID NO: 526198 - RNA, 21 nt, Human
ugggugugguggcaugugccu

SEQ ID NO: 526199 - RNA, 22 nt, Human
ugggugugguggcaugugccug

SEQ ID NO: 526200 - RNA, 29 nt, Human
ugggugugguggcaugugccuggaguccc

SEQ ID NO: 526201 - RNA, 24 nt, Human
ugggugugguggcgcaccccugua

SEQ ID NO: 526202 - RNA, 24 nt, Human
ugggugugguggcgcauaccugug

SEQ ID NO: 526203 - RNA, 24 nt, Human
ugggugugguggcgcaugccugua

SEQ ID NO: 526204 - RNA, 24 nt, Human
ugggugugguggcgcgcaccugua

SEQ ID NO: 526205 - RNA, 24 nt, Human
ugggugugguggcgcgugccugua

SEQ ID NO: 526206 - RNA, 23 nt, Human
ugggugugguggcggcgccugua

SEQ ID NO: 526207 - RNA, 24 nt, Human
ugggugugguggcgggcaccugua

SEQ ID NO: 526208 - RNA, 23 nt, Human
ugggugugguggcgggcgcccgu

SEQ ID NO: 526209 - RNA, 24 nt, Human
ugggugugguggcgggcgccugua

SEQ ID NO: 526210 - RNA, 24 nt, Human
ugggugugguggcgggugccugua

SEQ ID NO: 526211 - RNA, 24 nt, Human
ugggugugguggcgugcaccugua

SEQ ID NO: 526212 - RNA, 24 nt, Human
ugggugugguggcgugcgccugua

SEQ ID NO: 526213 - RNA, 24 nt, Human
ugggugugguggcgugugccugua

SEQ ID NO: 526214 - RNA, 24 nt, Human
ugggugugguggcgugugccugug

SEQ ID NO: 526215 - RNA, 24 nt, Human
ugggugugguggcucaagccugua

SEQ ID NO: 526216 - RNA, 20 nt, Human
ugggugugguggcucacacc

SEQ ID NO: 526217 - RNA, 22 nt, Human
ugggugugguggcucacaccug

SEQ ID NO: 526218 - RNA, 24 nt, Human
ugggugugguggcucacaccugua

SEQ ID NO: 526219 - RNA, 24 nt, Human
ugggugugguggcucacacuugua

SEQ ID NO: 526220 - RNA, 21 nt, Human
ugggugugguggcucacgccu

SEQ ID NO: 526221 - RNA, 24 nt, Human
ugggugugguggcucacgccugua

SEQ ID NO: 526222 - RNA, 24 nt, Human
ugggugugguggcucauaccugua

SEQ ID NO: 526223 - RNA, 24 nt, Human
ugggugugguggcucaugccugua

SEQ ID NO: 526224 - RNA, 21 nt, Human
ugggugugguggcucccaccu

SEQ ID NO: 526225 - RNA, 21 nt, Human
uggguguggugggcaccugua

SEQ ID NO: 526226 - RNA, 24 nt, Human
ugggugugguggggggcacccgua

SEQ ID NO: 526227 - RNA, 24 nt, Human
ugggugugguggggggcaccugua

SEQ ID NO: 526228 - RNA, 24 nt, Human
ugggugugguggugcacaccugua

SEQ ID NO: 526229 - RNA, 24 nt, Human
ugggugugguggugcacgccugua

SEQ ID NO: 526230 - RNA, 24 nt, Human
ugggugugguggugcacuccugua

SEQ ID NO: 526231 - RNA, 24 nt, Human
ugggugugguggugcaugccugua

SEQ ID NO: 526232 - RNA, 24 nt, Human
ugggugugguggugggcaccugua

SEQ ID NO: 526233 - RNA, 23 nt, Human
ugggugugguggugugaucugua

SEQ ID NO: 526234 - RNA, 22 nt, Human
uggguguggugucacaugccug

SEQ ID NO: 526235 - RNA, 24 nt, Human
ugggugugguugcacacgccugua

SEQ ID NO: 526236 - RNA, 32 nt, Human
uggguguguaccacugccucuggcuuuauuuu

SEQ ID NO: 526237 - RNA, 19 nt, Human
uggguguguaccauaccug

SEQ ID NO: 526238 - RNA, 32 nt, Human
uggguguguaugugugcauuuuccacacuuuu

SEQ ID NO: 526239 - RNA, 32 nt, Human
ugggugugugaaauuccagagcuuugggggag

SEQ ID NO: 526240 - RNA, 31 nt, Human
ugggugugugagagagcggcugguucauugu

SEQ ID NO: 526241 - RNA, 32 nt, Human
ugggugugugaguggcuaugauccuaguuguc

SEQ ID NO: 526242 - RNA, 32 nt, Human
ugggugugugggcagucucgggucucucggga

SEQ ID NO: 526243 - RNA, 31 nt, Human
uggguguucaauaaagaaccauuuggagaug

SEQ ID NO: 526244 - RNA, 32 nt, Human
uggguguucacuuuuuccuuuuugauugaaua

SEQ ID NO: 526245 - RNA, 32 nt, Human
uggguguucucaguccuugccaugaaguaugg

SEQ ID NO: 526246 - RNA, 32 nt, Human
uggguguucugccuccacuccuuacugccaag

SEQ ID NO: 526247 - RNA, 32 nt, Human
uggguguugcucccuuauccccaaaucacucu

SEQ ID NO: 526248 - RNA, 32 nt, Human
uggguguuggcacccagccacuauucugccaa

SEQ ID NO: 526249 - RNA, 32 nt, Human
uggguguuuaaaggacaaauagcugcuagaau

SEQ ID NO: 526250 - RNA, 32 nt, Human
uggguguuugggaaaggcagggcccugaaaug

SEQ ID NO: 526251 - RNA, 32 nt, Human
uggguguuuuagcauuacuguguaaagacuug

SEQ ID NO: 526252 - RNA, 32 nt, Human
uggguguuuuucuucuguggugagugaaacaa

SEQ ID NO: 526253 - RNA, 32 nt, Human
uggguuaaaguuaugguuccagaagcuuccaa

SEQ ID NO: 526254 - RNA, 32 nt, Human
uggguuaacaggauugccgacagaucaggccc

SEQ ID NO: 526255 - RNA, 32 nt, Human
uggguuacacaaaagaauucacagaugguaaa

SEQ ID NO: 526256 - RNA, 32 nt, Human
uggguuacaccuguaaucccagcacuuuggga

SEQ ID NO: 526257 - RNA, 32 nt, Human
uggguuacugcaaccucugccccucgggauuc

SEQ ID NO: 526258 - RNA, 32 nt, Human
uggguuagagcuagagagaaggccccaagcuu

SEQ ID NO: 526259 - RNA, 32 nt, Human
uggguuaggcugucccagcugucugaguguuu

SEQ ID NO: 526260 - RNA, 32 nt, Human
uggguuagugugaaaaagaguuuggcugauuc

SEQ ID NO: 526261 - RNA, 32 nt, Human
uggguuauccuaggaagagguuacuccuaaua

SEQ ID NO: 526262 - RNA, 32 nt, Human
uggguuaucuggcuccaaaaccccuguccuuu

SEQ ID NO: 526263 - RNA, 32 nt, Human
uggguuaugggaugugggcaucccuggguucu

SEQ ID NO: 526264 - RNA, 32 nt, Human
uggguuauuggcaaagaagcaaacaggacaca

SEQ ID NO: 526265 - RNA, 32 nt, Human
uggguucaagcaauccucccaccucggccucc

SEQ ID NO: 526266 - RNA, 32 nt, Human
uggguucaagcaauucucccaccucagcuggg

SEQ ID NO: 526267 - RNA, 32 nt, Human
uggguucaagccaucccuccugccucagccuc

SEQ ID NO: 526268 - RNA, 32 nt, Human
uggguucaagccauccucccaccucagccucc

SEQ ID NO: 526269 - RNA, 32 nt, Human
uggguucaagcgauccucccacuucagccuuu

SEQ ID NO: 526270 - RNA, 32 nt, Human
uggguucaagcgauucucccaccccagccucc

SEQ ID NO: 526271 - RNA, 32 nt, Human
uggguucaagcuauucugccucagccucccaa

SEQ ID NO: 526272 - RNA, 32 nt, Human
uggguucaaguaacccucccaccucagcuuuc

SEQ ID NO: 526273 - RNA, 32 nt, Human
uggguucaaguaauccucccaccucagccucc

SEQ ID NO: 526274 - RNA, 32 nt, Human
uggguucaauuuaaaauaggagaggcuuucuc

SEQ ID NO: 526275 - RNA, 32 nt, Human
uggguucacaccaucacccuuucuucccucua

SEQ ID NO: 526276 - RNA, 32 nt, Human
uggguucacaccauucuccugccucagccucc

SEQ ID NO: 526277 - RNA, 32 nt, Human
uggguucacaccauucucuugccucagccucc

SEQ ID NO: 526278 - RNA, 31 nt, Human
uggguucacagcuggacugggagcagcagac

SEQ ID NO: 526279 - RNA, 31 nt, Human
uggguucacagcuguggggacccaggcaggc

SEQ ID NO: 526280 - RNA, 32 nt, Human
uggguucacgccauucucccaccucagcuucc

SEQ ID NO: 526281 - RNA, 32 nt, Human
uggguucacugcaaccuccgccucuuggguuc

SEQ ID NO: 526282 - RNA, 32 nt, Human
uggguucacugcaaccucugccuccagguuca

SEQ ID NO: 526283 - RNA, 32 nt, Human
uggguucagaacaggugcaugagccccacagc

SEQ ID NO: 526284 - RNA, 32 nt, Human
uggguucaggcaauucucccaccucagccucc

SEQ ID NO: 526285 - RNA, 32 nt, Human
uggguucagggagggguuggagcagugcuggg

SEQ ID NO: 526286 - RNA, 32 nt, Human
uggguucauauuccucuucaauucugcugucu

SEQ ID NO: 526287 - RNA, 32 nt, Human
uggguucaugccauucuccugccucagccucc

SEQ ID NO: 526288 - RNA, 32 nt, Human
uggguucaugccauucuccugccucagucucc

SEQ ID NO: 526289 - RNA, 32 nt, Human
uggguucaugccauucuccugccucggccuuc

SEQ ID NO: 526290 - RNA, 32 nt, Human
uggguucaugccauucuccugcuucagccucc

SEQ ID NO: 526291 - RNA, 32 nt, Human
uggguucaugccauuuuccugccucagccucc

SEQ ID NO: 526292 - RNA, 32 nt, Human
uggguucauucaauaaacacuuacugagcacc

SEQ ID NO: 526293 - RNA, 32 nt, Human
uggguucauucaauaaacacuuacugagcacg

SEQ ID NO: 526294 - RNA, 32 nt, Human
uggguuccaaucccagcucugccuuugaagca

SEQ ID NO: 526295 - RNA, 32 nt, Human
uggguuccagcccccuuucccuuccuccuccu

SEQ ID NO: 526296 - RNA, 32 nt, Human
uggguuccaucucugucuccagccugcccacu

SEQ ID NO: 526297 - RNA, 32 nt, Human
uggguuccauuccuaacucugccucaaacugu

SEQ ID NO: 526298 - RNA, 32 nt, Human
uggguuccauuuggugggugggggaggaaguu

SEQ ID NO: 526299 - RNA, 32 nt, Human
uggguucccuuuccuuccaucccuacccccua

SEQ ID NO: 526300 - RNA, 32 nt, Human
uggguucccuuuccuucccaccccuguggcca

SEQ ID NO: 526301 - RNA, 32 nt, Human
uggguuccuugggaggaaguuguaguggugau

SEQ ID NO: 526302 - RNA, 32 nt, Human
uggguucgagguggaggcugcagcugaaggug

SEQ ID NO: 526303 - RNA, 32 nt, Human
uggguucgcucucagcucugcagcugucugcg

SEQ ID NO: 526304 - RNA, 32 nt, Human
uggguucuacagccuugucccccucccccuca

SEQ ID NO: 526305 - RNA, 32 nt, Human
uggguucuagggaacagauugaccccaaacau

SEQ ID NO: 526306 - RNA, 32 nt, Human
uggguucuaugcacgacuucagccuggagagg

SEQ ID NO: 526307 - RNA, 32 nt, Human
uggguucuccucagugagggaucccugcccug

SEQ ID NO: 526308 - RNA, 32 nt, Human
uggguucucggugugcagaggcuguagagaga

SEQ ID NO: 526309 - RNA, 32 nt, Human
uggguucugcauguguuccuggcagcugggcc

SEQ ID NO: 526310 - RNA, 32 nt, Human
uggguucugccgaacccuccucucacaggaag

SEQ ID NO: 526311 - RNA, 32 nt, Human
uggguucuguuucuccccuuggcugccuguaa

SEQ ID NO: 526312 - RNA, 32 nt, Human
uggguucuugugccuuccccucccgggcccag

SEQ ID NO: 526313 - RNA, 32 nt, Human
uggguucuuuacugcuggaucgcagguugggg

SEQ ID NO: 526314 - RNA, 32 nt, Human
uggguucuuugcugaaauuauaguugaauggc

SEQ ID NO: 526315 - RNA, 32 nt, Human
uggguugaacuauguuccucagaaagauaugu

SEQ ID NO: 526316 - RNA, 32 nt, Human
uggguugaauacaaguuuccaaaacuuuaaaa

SEQ ID NO: 526317 - RNA, 32 nt, Human
uggguugacaccauuuuccugccucagccucc

SEQ ID NO: 526318 - RNA, 32 nt, Human
uggguugacaggagcagcaaaccaccauggca

SEQ ID NO: 526319 - RNA, 32 nt, Human
uggguugacaggugcagcaaaccaccauggca

SEQ ID NO: 526320 - RNA, 32 nt, Human
uggguugacaugcacacaacaccauuuucauu

SEQ ID NO: 526321 - RNA, 32 nt, Human
uggguugagagggagcagcagguaacugcgca

SEQ ID NO: 526322 - RNA, 32 nt, Human
uggguugagggaagagcuaucuggccuugggg

SEQ ID NO: 526323 - RNA, 32 nt, Human
uggguugaucaccuagaggagcucuggcuaag

SEQ ID NO: 526324 - RNA, 32 nt, Human
uggguugcaauacaaacugcucuugacaauga

SEQ ID NO: 526325 - RNA, 32 nt, Human
uggguugcagaggcaggcugcaucccggaauc

SEQ ID NO: 526326 - RNA, 32 nt, Human
uggguugcaggaggaggagcugggcagggccu

SEQ ID NO: 526327 - RNA, 32 nt, Human
uggguugcagugagccgagaucaugccacugc

SEQ ID NO: 526328 - RNA, 32 nt, Human
uggguugcagugagccgagaugucaccacugc

SEQ ID NO: 526329 - RNA, 32 nt, Human
uggguugccuggggugauccucccuccugcgu

SEQ ID NO: 526330 - RNA, 32 nt, Human
uggguugcuguuaacccagggccuagacuucu

SEQ ID NO: 526331 - RNA, 32 nt, Human
uggguuggaaaagagaagaugaagggacaucc

SEQ ID NO: 526332 - RNA, 32 nt, Human
uggguuggaauccagccccaccucuuuuaugc

SEQ ID NO: 526333 - RNA, 32 nt, Human
uggguuggaugucccucacugcagccuguccg

SEQ ID NO: 526334 - RNA, 32 nt, Human
uggguuggcugcaguagugagaggcugggggu

SEQ ID NO: 526335 - RNA, 32 nt, Human
uggguuggcuuccugcccccagcugcagcuau

SEQ ID NO: 526336 - RNA, 32 nt, Human
uggguugggaggauugcuuaaggccaggaguu

SEQ ID NO: 526337 - RNA, 32 nt, Human
uggguugggauuacaggcgugagccaccgcgu

SEQ ID NO: 526338 - RNA, 32 nt, Human
uggguugggcugcaggccuggccgugagcggg

SEQ ID NO: 526339 - RNA, 32 nt, Human
uggguugggcugcccaggcuggucagagcuca

SEQ ID NO: 526340 - RNA, 32 nt, Human
uggguugggcuggagagguauguguguguaaa

SEQ ID NO: 526341 - RNA, 32 nt, Human
uggguugguagaugcagcaaaccaccauggca

SEQ ID NO: 526342 - RNA, 32 nt, Human
uggguugguaggugcagcaaaccaccauggca

SEQ ID NO: 526343 - RNA, 32 nt, Human
uggguuggugguaacaguggaggcaggguagg

SEQ ID NO: 526344 - RNA, 32 nt, Human
uggguuguaaacaugugguaguaccagaguau

SEQ ID NO: 526345 - RNA, 20 nt, Human
uggguugugacuucuacuga

SEQ ID NO: 526346 - RNA, 32 nt, Human
uggguugugccuguaaucccagcuacuuggga

SEQ ID NO: 526347 - RNA, 32 nt, Human
uggguugugcugaaacagcucuucugagaacu

SEQ ID NO: 526348 - RNA, 32 nt, Human
uggguugugggaugagaugcagcaacccuauu

SEQ ID NO: 526349 - RNA, 32 nt, Human
uggguugugggcagaggagccauccuggcgga

SEQ ID NO: 526350 - RNA, 32 nt, Human
uggguuguggggucauguagggguggguugcc

SEQ ID NO: 526351 - RNA, 32 nt, Human
uggguuguugggccucucuggagcugagcaca

SEQ ID NO: 526352 - RNA, 24 nt, Human
uggguuuagaaagaucucaggaaa

SEQ ID NO: 526353 - RNA, 32 nt, Human
uggguuuauguuucaccucauuuggaacaaaa

SEQ ID NO: 526354 - RNA, 21 nt, Human
uggguuucaccauguuggcca

SEQ ID NO: 526355 - RNA, 32 nt, Human
uggguuucaugucaucuucugcuaacacaacu

SEQ ID NO: 526356 - RNA, 32 nt, Human
uggguuuccagaaaacaucuccaaagcuauac

SEQ ID NO: 526357 - RNA, 32 nt, Human
uggguuuccuggaaguggauuugggccaagaa

SEQ ID NO: 526358 - RNA, 21 nt, Human
uggguuucuagcaccuuaucu

SEQ ID NO: 526359 - RNA, 32 nt, Human
uggguuucucacaagcguccuuccucauagga

SEQ ID NO: 526360 - RNA, 23 nt, Human
uggguuucuguggcacucuuuua

SEQ ID NO: 526361 - RNA, 32 nt, Human
uggguuugaagggcggaucucagucccuggcu

SEQ ID NO: 526362 - RNA, 32 nt, Human
uggguuugagcaauccucccaccucagccucc

SEQ ID NO: 526363 - RNA, 32 nt, Human
uggguuugagcccugcuucugugcacagccac

SEQ ID NO: 526364 - RNA, 32 nt, Human
uggguuugagcugggcuuauccuccaacugug

SEQ ID NO: 526365 - RNA, 32 nt, Human
uggguuugccaucuuuuuguuuucuuugaaaa

SEQ ID NO: 526366 - RNA, 32 nt, Human
uggguuuggaagggggaugcacuguggaucug

SEQ ID NO: 526367 - RNA, 32 nt, Human
uggguuuggaaggugugcuugcugugguacug

SEQ ID NO: 526368 - RNA, 32 nt, Human
uggguuuggagaacacaguggcugguuuuaaa

SEQ ID NO: 526369 - RNA, 20 nt, Human
uggguuuggggccugggaca

SEQ ID NO: 526370 - RNA, 21 nt, Human
uggguuuggucuacccaccca

SEQ ID NO: 526371 - RNA, 32 nt, Human
uggguuugguuagaggaaggcugaacucuuca

SEQ ID NO: 526372 - RNA, 32 nt, Human
uggguuugucuugucuucuuuuuaauuuaugg

SEQ ID NO: 526373 - RNA, 32 nt, Human
uggguuuguguguguggaugugguuucugccu

SEQ ID NO: 526374 - RNA, 32 nt, Human
uggguuuuaccacugcacgaccaucuggcucu

SEQ ID NO: 526375 - RNA, 22 nt, Human
uggguuuucaauaaacuugcca

SEQ ID NO: 526376 - RNA, 32 nt, Human
uggguuuuccauccuccgaagacaucaccuuu

SEQ ID NO: 526377 - RNA, 32 nt, Human
uggguuuuccucuucccuaucuccccuccucc

SEQ ID NO: 526378 - RNA, 32 nt, Human
uggguuuugaguuagacaguccugggcuugag

SEQ ID NO: 526379 - RNA, 32 nt, Human
uggguuuugcucugcugaugauggucagggac

SEQ ID NO: 526380 - RNA, 32 nt, Human
uggguuuuguuuaggaggguggguggggaagg

SEQ ID NO: 526381 - RNA, 32 nt, Human
uggguuuuguuucuuuccuuccuuccuuccuu

SEQ ID NO: 526382 - RNA, 32 nt, Human
uggguuuuuaauccuggccuugcugcuagaaa

SEQ ID NO: 526383 - RNA, 21 nt, Human
ugguaaaaagaggcugagaca

SEQ ID NO: 526384 - RNA, 32 nt, Human
ugguaaaaaugucaguuugacacugccaagug

SEQ ID NO: 526385 - RNA, 32 nt, Human
ugguaaaacaagucugaaagcugcagugucau

SEQ ID NO: 526386 - RNA, 32 nt, Human
ugguaaaaccccaucucuaccaaaaauacaaa

SEQ ID NO: 526387 - RNA, 32 nt, Human
ugguaaaacuuacaauccucaaaacuucuuac

SEQ ID NO: 526388 - RNA, 32 nt, Human
ugguaaaagucaaacaguauaaaaggguauac

SEQ ID NO: 526389 - RNA, 32 nt, Human
ugguaaaauagugagaccucaucucuacaaag

SEQ ID NO: 526390 - RNA, 32 nt, Human
ugguaaacccagcugggagguuucuaggcagc

SEQ ID NO: 526391 - RNA, 32 nt, Human
ugguaaagacgggguuucgccuuguugcccag

SEQ ID NO: 526392 - RNA, 32 nt, Human
ugguaaagauggcauuucaccauguuguacag

SEQ ID NO: 526393 - RNA, 32 nt, Human
ugguaaaggggugcuggaggccauggaggagc

SEQ ID NO: 526394 - RNA, 32 nt, Human
ugguaaauagauaagaaaauugagacucauag

SEQ ID NO: 526395 - RNA, 32 nt, Human
ugguaaauaguugggaggcaaagggaagaaug

SEQ ID NO: 526396 - RNA, 22 nt, Human
ugguaaauauccagcgcuucac

SEQ ID NO: 526397 - RNA, 32 nt, Human
ugguaaauugcaauucuuucuggggauauauu

SEQ ID NO: 526398 - RNA, 32 nt, Human
ugguaacaagacuuagaaggagggcccaggca

SEQ ID NO: 526399 - RNA, 32 nt, Human
ugguaacacauauuuuguuugaggggccacug

SEQ ID NO: 526400 - RNA, 32 nt, Human
ugguaacaccacugcacuccaaccugggcaac

SEQ ID NO: 526401 - RNA, 32 nt, Human
ugguaacagacagaagaauggaagcauuccag

SEQ ID NO: 526402 - RNA, 32 nt, Human
ugguaacagauggguagaggcagcucagguga

SEQ ID NO: 526403 - RNA, 21 nt, Human
ugguaacaggcugggugcaau

SEQ ID NO: 526404 - RNA, 22 nt, Human
ugguaacaggcugggugcaaug

SEQ ID NO: 526405 - RNA, 32 nt, Human
ugguaacaggcugggugcaauggcucacaccu

SEQ ID NO: 526406 - RNA, 32 nt, Human
ugguaacaguaugauaaaauucaugcuguuau

SEQ ID NO: 526407 - RNA, 32 nt, Human
ugguaacaucucugacuucucuaccuccucug

SEQ ID NO: 526408 - RNA, 21 nt, Human
ugguaacaugcacauccuguu

SEQ ID NO: 526409 - RNA, 22 nt, Human
ugguaaccaggcugugcgccug

SEQ ID NO: 526410 - RNA, 32 nt, Human
ugguaaccugaaagauacgacauugcugagcc

SEQ ID NO: 526411 - RNA, 32 nt, Human
ugguaacucaagacugccugccuagguuucuu

SEQ ID NO: 526412 - RNA, 32 nt, Human
ugguaacucauuuugauuguuauaacaucuca

SEQ ID NO: 526413 - RNA, 32 nt, Human
ugguaacucucuuccuucuuuuucucccuacc

SEQ ID NO: 526414 - RNA, 32 nt, Human
ugguaacuucucugagcuucaguuuccaagug

SEQ ID NO: 526415 - RNA, 32 nt, Human
ugguaagaccucaaacugcaaaugacuauuca

SEQ ID NO: 526416 - RNA, 32 nt, Human
ugguaagacuucuggguucaugaaguuucggc

SEQ ID NO: 526417 - RNA, 26 nt, Human
ugguaagagcuguaguuagcaaaauu

SEQ ID NO: 526418 - RNA, 32 nt, Human
ugguaagaggaagggaaaugcagccucaguaa

SEQ ID NO: 526419 - RNA, 32 nt, Human
ugguaagauguguuuccgugcaugucagugcu

SEQ ID NO: 526420 - RNA, 32 nt, Human
ugguaagauguucagucaaaauucggcccuug

SEQ ID NO: 526421 - RNA, 32 nt, Human
ugguaagcagagcccagggccucuagggcagu

SEQ ID NO: 526422 - RNA, 32 nt, Human
ugguaagcauuuuuauaaacccacucauuuua

SEQ ID NO: 526423 - RNA, 32 nt, Human
ugguaaggucuggggugacacucuauauacua

SEQ ID NO: 526424 - RNA, 32 nt, Human
ugguaaguucuuccagcugaagccacuuuuuc

SEQ ID NO: 526425 - RNA, 32 nt, Human
ugguaauaagccucgcagcccagguccagagc

SEQ ID NO: 526426 - RNA, 32 nt, Human
ugguaauagcuucuauaaaaucugccauaguu

SEQ ID NO: 526427 - RNA, 32 nt, Human
ugguaauauuuggagcuuuauagccuguauuc

SEQ ID NO: 526428 - RNA, 21 nt, Human
ugguaaucauuuucuucaggg

SEQ ID NO: 526429 - RNA, 32 nt, Human
ugguaauccaacaaagaaacagauggugagaa

SEQ ID NO: 526430 - RNA, 32 nt, Human
ugguaaugcucacuccagguucugcaaaaguu

SEQ ID NO: 526431 - RNA, 30 nt, Human
ugguaaugggcccugccgccaggccucggc

SEQ ID NO: 526432 - RNA, 32 nt, Human
ugguaauuccauuauaaaaccuaaugaaacaa

SEQ ID NO: 526433 - RNA, 32 nt, Human
ugguaauuguagagaaucaggagaaguuacgu

SEQ ID NO: 526434 - RNA, 32 nt, Human
ugguaauuugauuccccuuugcagugauuggu

SEQ ID NO: 526435 - RNA, 32 nt, Human
ugguacaaaccagcccaagugcaaaggcccaa

SEQ ID NO: 526436 - RNA, 32 nt, Human
ugguacaaauagauggagaccugcugggauca

SEQ ID NO: 526437 - RNA, 32 nt, Human
ugguacaaaugacauuuguucuuucugugaaa

SEQ ID NO: 526438 - RNA, 32 nt, Human
ugguacaagauguggagguggaagacagugau

SEQ ID NO: 526439 - RNA, 32 nt, Human
ugguacaaucauggcucacugcagccuccacc

SEQ ID NO: 526440 - RNA, 23 nt, Human
ugguacaaucucggcucacugca

SEQ ID NO: 526441 - RNA, 23 nt, Human
ugguacaaucuggcucacugcag

SEQ ID NO: 526442 - RNA, 24 nt, Human
ugguacacaccuguaaucccagcu

SEQ ID NO: 526443 - RNA, 32 nt, Human
ugguacacaccuuuguccacuggguaaauuau

SEQ ID NO: 526444 - RNA, 32 nt, Human
ugguacaccuacaggcuggaguguaaaaugga

SEQ ID NO: 526445 - RNA, 24 nt, Human
ugguacacgccuguaaucccagcu

SEQ ID NO: 526446 - RNA, 32 nt, Human
ugguacacugaauucucuggguggcuuucuug

SEQ ID NO: 526447 - RNA, 32 nt, Human
ugguacagaaauacaucuuugcucugagaaua

SEQ ID NO: 526448 - RNA, 32 nt, Human
ugguacagacgggguuucaccauguuggccag

SEQ ID NO: 526449 - RNA, 32 nt, Human
ugguacagauguguaugggaaaccccaacccc

SEQ ID NO: 526450 - RNA, 32 nt, Human
ugguacagcccucccuguucuaccaccuuggu

SEQ ID NO: 526451 - RNA, 32 nt, Human
ugguacagcugcaggccguggucagggacggc

SEQ ID NO: 526452 - RNA, 32 nt, Human
ugguacaggagaaggugagauggagagaaagc

SEQ ID NO: 526453 - RNA, 32 nt, Human
ugguacagguuguugagaugaaggagagaugg

SEQ ID NO: 526454 - RNA, 32 nt, Human
ugguacaguggaagaacuggccagagagucug

SEQ ID NO: 526455 - RNA, 32 nt, Human
ugguacaugaacaguuggaacugcugacuuuc

SEQ ID NO: 526456 - RNA, 23 nt, Human
ugguacaugccuguaaucccagc

SEQ ID NO: 526457 - RNA, 24 nt, Human
ugguacaugccuguaaucccagcu

SEQ ID NO: 526458 - RNA, 32 nt, Human
ugguacaugccuguaaucccagcuacacugga

SEQ ID NO: 526459 - RNA, 32 nt, Human
ugguacaugccuguaaucccagcuacucagga

SEQ ID NO: 526460 - RNA, 32 nt, Human
ugguacaugccuguaaucccagcuacuuggga

SEQ ID NO: 526461 - RNA, 32 nt, Human
ugguacaugccuguagcccuagcuacucugga

SEQ ID NO: 526462 - RNA, 32 nt, Human
ugguacaugccuguagucccagauacucggga

SEQ ID NO: 526463 - RNA, 32 nt, Human
ugguaccaagcccacccuugggguuccugcuc

SEQ ID NO: 526464 - RNA, 32 nt, Human
ugguaccacaccagggccucagccuggccccu

SEQ ID NO: 526465 - RNA, 32 nt, Human
ugguaccacugcacuccagccugggugacaga

SEQ ID NO: 526466 - RNA, 32 nt, Human
ugguacccagaagaaggagcaugagugggcaa

SEQ ID NO: 526467 - RNA, 32 nt, Human
ugguacccagggugaguugguggagaacagag

SEQ ID NO: 526468 - RNA, 32 nt, Human
ugguacccaggugcccuucaggcucuaaccaa

SEQ ID NO: 526469 - RNA, 32 nt, Human
ugguacccccaucacccagggcguggagauga

SEQ ID NO: 526470 - RNA, 32 nt, Human
ugguaccccugcacuccagcccagguuacaga

SEQ ID NO: 526471 - RNA, 32 nt, Human
ugguaccucauuuuggggagaaccuuaaaccc

SEQ ID NO: 526472 - RNA, 32 nt, Human
ugguaccucugcacugcagccugggcaacaga

SEQ ID NO: 526473 - RNA, 32 nt, Human
ugguaccugcagcacguuuccaugccugggag

SEQ ID NO: 526474 - RNA, 32 nt, Human
ugguaccugcagcgugggggacgugcuucuac

SEQ ID NO: 526475 - RNA, 21 nt, Human
ugguaccuguguucgucaggg

SEQ ID NO: 526476 - RNA, 32 nt, Human
ugguaccuuauuugucuaguaucuuauuugug

SEQ ID NO: 526477 - RNA, 32 nt, Human
ugguaccuucaauguaugacuccugggagaau

SEQ ID NO: 526478 - RNA, 24 nt, Human
ugguaccuucccccagcuuuccau

SEQ ID NO: 526479 - RNA, 32 nt, Human
ugguaccuucuggaggaggacgguuuccugga

SEQ ID NO: 526480 - RNA, 32 nt, Human
ugguaccuuuacaucucccaacuuuccguucc

SEQ ID NO: 526481 - RNA, 32 nt, Human
ugguacgacuccuggccuuuuaucuaaaggac

SEQ ID NO: 526482 - RNA, 32 nt, Human
ugguacgaucacagcucacugcagccuccacc

SEQ ID NO: 526483 - RNA, 23 nt, Human
ugguacgaucuuggcucacugca

SEQ ID NO: 526484 - RNA, 32 nt, Human
ugguacgugccuguaggccuagcuacuuagga

SEQ ID NO: 526485 - RNA, 32 nt, Human
ugguacgugccuguagucccagcuacuucggg

SEQ ID NO: 526486 - RNA, 32 nt, Human
ugguacgugggugaggggauggaggaaggcga

SEQ ID NO: 526487 - RNA, 32 nt, Human
ugguacuagacauauaaucacagggagucauu

SEQ ID NO: 526488 - RNA, 32 nt, Human
ugguacucaaagcugcuuaggaaucaaaaugu

SEQ ID NO: 526489 - RNA, 23 nt, Human
ugguacucaccucagugcugcac

SEQ ID NO: 526490 - RNA, 31 nt, Human
ugguacucaguaaauauuuguugaaaugaau

SEQ ID NO: 526491 - RNA, 32 nt, Human
ugguacuccuaugcaauauuacucagcuuuuu

SEQ ID NO: 526492 - RNA, 32 nt, Human
ugguacucugggagauugugacccuggcagaa

SEQ ID NO: 526493 - RNA, 32 nt, Human
ugguacugcaguggcaacuacaaagguaucuu

SEQ ID NO: 526494 - RNA, 32 nt, Human
ugguacugggggagggagagaucugacaaaua

SEQ ID NO: 526495 - RNA, 32 nt, Human
ugguacuguacagcuggcucuacuuccccaug

SEQ ID NO: 526496 - RNA, 32 nt, Human
ugguacuuaaugaugugacucucugauccugu

SEQ ID NO: 526497 - RNA, 32 nt, Human
ugguacuuugguggccacauaagccauuauuc

SEQ ID NO: 526498 - RNA, 31 nt, Human
ugguacuuuguggaaagaggggagaauaaag

SEQ ID NO: 526499 - RNA, 24 nt, Human
ugguacuuuuccacaguguaccau

SEQ ID NO: 526500 - RNA, 32 nt, Human
ugguagaaaaaggggccugagugaaggauuau

SEQ ID NO: 526501 - RNA, 32 nt, Human
ugguagaaaacaauauaaaaaguguucaugug

SEQ ID NO: 526502 - RNA, 32 nt, Human
ugguagaaacggaaguagaaguaggcuggagg

SEQ ID NO: 526503 - RNA, 32 nt, Human
ugguagaaacuccucuuucuucauaguccuca

SEQ ID NO: 526504 - RNA, 32 nt, Human
ugguagaauuuguaugcucuuagagcccaaca

SEQ ID NO: 526505 - RNA, 32 nt, Human
ugguagagaaaggguuucaucauuguuggcug

SEQ ID NO: 526506 - RNA, 32 nt, Human
ugguagagacagaguuucaccagguuggucag

SEQ ID NO: 526507 - RNA, 32 nt, Human
ugguagagacaggguaucuccauguuggucag

SEQ ID NO: 526508 - RNA, 32 nt, Human
ugguagagacaggguuucaccauguuagccag

SEQ ID NO: 526509 - RNA, 32 nt, Human
ugguagagacaggguuucaccauguuggccag

SEQ ID NO: 526510 - RNA, 32 nt, Human
ugguagagacaggguuucaccauguuggucag

SEQ ID NO: 526511 - RNA, 32 nt, Human
ugguagagacaggguuucgccauguugcccag

SEQ ID NO: 526512 - RNA, 32 nt, Human
ugguagagacgggauucuaccauguugcccag

SEQ ID NO: 526513 - RNA, 32 nt, Human
ugguagagacgggguuucaacauguugaccag

SEQ ID NO: 526514 - RNA, 32 nt, Human
ugguagagacgggguuucaccaguguuggcca

SEQ ID NO: 526515 - RNA, 32 nt, Human
ugguagagacgggguuucaccguguuggccag

SEQ ID NO: 526516 - RNA, 32 nt, Human
ugguagagacgggguuucacuguguuagccag

SEQ ID NO: 526517 - RNA, 32 nt, Human
ugguagagacgggguuucacuguguuggccag

SEQ ID NO: 526518 - RNA, 32 nt, Human
ugguagagacgggguuucaucauguuggccag

SEQ ID NO: 526519 - RNA, 32 nt, Human
ugguagagacgggguuuccccacguugaccag

SEQ ID NO: 526520 - RNA, 32 nt, Human
ugguagagauaggguuucacauguuggccaag

SEQ ID NO: 526521 - RNA, 32 nt, Human
ugguagagauggaguuucaccaugguggucag

SEQ ID NO: 526522 - RNA, 32 nt, Human
ugguagagauggggucucacuauguugcccag

SEQ ID NO: 526523 - RNA, 32 nt, Human
ugguagagaugggguuucaccaaguuggcuag

SEQ ID NO: 526524 - RNA, 32 nt, Human
ugguagagaugggguuucaccaugcuggccag

SEQ ID NO: 526525 - RNA, 32 nt, Human
ugguagagaugggguuucaccauguuggacag

SEQ ID NO: 526526 - RNA, 32 nt, Human
ugguagagaugggguuucaccauguuggccag

SEQ ID NO: 526527 - RNA, 32 nt, Human
ugguagagaugggguuucaccauguuggcuag

SEQ ID NO: 526528 - RNA, 32 nt, Human
ugguagagaugggguuucacuguuuuggccag

SEQ ID NO: 526529 - RNA, 32 nt, Human
ugguagagaugggguuucgccauguugcccag

SEQ ID NO: 526530 - RNA, 21 nt, Human
ugguagaggaggccccuccug

SEQ ID NO: 526531 - RNA, 32 nt, Human
ugguagaggcgggguuucgucauguuggccag

SEQ ID NO: 526532 - RNA, 20 nt, Human
ugguagagggucccgggaag

SEQ ID NO: 526533 - RNA, 32 nt, Human
ugguagauaagaaugagucagcagugauuguu

SEQ ID NO: 526534 - RNA, 32 nt, Human
ugguagauauugaauggcuuggaaaagaggua

SEQ ID NO: 526535 - RNA, 32 nt, Human
ugguagauccacccuuaugcuucucaguuuag

SEQ ID NO: 526536 - RNA, 32 nt, Human
ugguagaugccuguaauuccagcuacucagga

SEQ ID NO: 526537 - RNA, 32 nt, Human
ugguagaugcgaaauuuaucugugcaugaaag

SEQ ID NO: 526538 - RNA, 22 nt, Human
ugguagauguuugauugacuua

SEQ ID NO: 526539 - RNA, 21 nt, Human
ugguagauugcuguugaucuu

SEQ ID NO: 526540 - RNA, 32 nt, Human
ugguagauuuugccaggcuucucccaacagag

SEQ ID NO: 526541 - RNA, 32 nt, Human
ugguagcaaauguauauguaugaguuuguauu

SEQ ID NO: 526542 - RNA, 32 nt, Human
ugguagcaaucagggaagcuggccuacaugcu

SEQ ID NO: 526543 - RNA, 32 nt, Human
ugguagcaccacugcacuucagccuggacaac

SEQ ID NO: 526544 - RNA, 32 nt, Human
ugguagcagaagcagcagugaagaugaugugg

SEQ ID NO: 526545 - RNA, 18 nt, Human
ugguagcagaugguccca

SEQ ID NO: 526546 - RNA, 32 nt, Human
ugguagcaguagauuccaggaggagaagggua

SEQ ID NO: 526547 - RNA, 32 nt, Human
ugguagccacccugguucuuguugacuugagg

SEQ ID NO: 526548 - RNA, 32 nt, Human
ugguagcccugggguagccuguaguagacucg

SEQ ID NO: 526549 - RNA, 23 nt, Human
ugguagccgaguggcacgcgggg

SEQ ID NO: 526550 - RNA, 32 nt, Human
ugguagccuagaguccuggggagcuucugucc

SEQ ID NO: 526551 - RNA, 32 nt, Human
ugguagccucagaagcagagcuguuuggcaga

SEQ ID NO: 526552 - RNA, 32 nt, Human
ugguagccuugccuuuuacccagcacagacga

SEQ ID NO: 526553 - RNA, 32 nt, Human
ugguagcgcacaccuguagucacagcuacucc

SEQ ID NO: 526554 - RNA, 32 nt, Human
ugguagcuauuccacccucugccugccugccu

SEQ ID NO: 526555 - RNA, 21 nt, Human
ugguagcucaugccuguaauc

SEQ ID NO: 526556 - RNA, 32 nt, Human
ugguagcucaugccuguaucccagcccuuugg

SEQ ID NO: 526557 - RNA, 32 nt, Human
ugguagcuccaccccaacucccuucugcuggg

SEQ ID NO: 526558 - RNA, 32 nt, Human
ugguagcucuaagaaaauaucuugcaagcucc

SEQ ID NO: 526559 - RNA, 32 nt, Human
ugguagcugagacugcaugcccagcuccaaau

SEQ ID NO: 526560 - RNA, 32 nt, Human
ugguagcuguagucuuagcuacucaggaggcu

SEQ ID NO: 526561 - RNA, 32 nt, Human
ugguagcuucuuuccucuucguccugaugcug

SEQ ID NO: 526562 - RNA, 32 nt, Human
ugguaggagcaucuguaagugcauuuaaauca

SEQ ID NO: 526563 - RNA, 32 nt, Human
ugguaggaucacugggacuccaagccucagca

SEQ ID NO: 526564 - RNA, 32 nt, Human
ugguaggcagcaaaagaccaaaucucaguugu

SEQ ID NO: 526565 - RNA, 32 nt, Human
ugguaggcaggagccccgcccucccaggcaca

SEQ ID NO: 526566 - RNA, 32 nt, Human
ugguaggcauuuccuaucaccuauuuccauuc

SEQ ID NO: 526567 - RNA, 32 nt, Human
ugguaggcgccuguaaucucagcuacuugaaa

SEQ ID NO: 526568 - RNA, 21 nt, Human
ugguaggcgucugcauucccu

SEQ ID NO: 526569 - RNA, 32 nt, Human
ugguaggcugggaacugaagagacuuguggua

SEQ ID NO: 526570 - RNA, 32 nt, Human
ugguagggaagugggaugcuccucagauauua

SEQ ID NO: 526571 - RNA, 32 nt, Human
ugguagggacagaguuucaccauguuggccag

SEQ ID NO: 526572 - RNA, 32 nt, Human
ugguagggagggagguauaguugggggacagg

SEQ ID NO: 526573 - RNA, 32 nt, Human
ugguagggcaugugccuguuucccucucagcc

SEQ ID NO: 526574 - RNA, 32 nt, Human
ugguagggggagaaggaggagcuggaggaggg

SEQ ID NO: 526575 - RNA, 32 nt, Human
ugguagggggcagagaaggaaaagcugagggg

SEQ ID NO: 526576 - RNA, 32 nt, Human
ugguagggguuguuugguuuugguuuucacug

SEQ ID NO: 526577 - RNA, 32 nt, Human
ugguaggguggaggggagagaagaagaugcug

SEQ ID NO: 526578 - RNA, 32 nt, Human
ugguagguaaugcaguuugaaaccauuucacu

SEQ ID NO: 526579 - RNA, 25 nt, Human
ugguagguccuagacgugguucccu

SEQ ID NO: 526580 - RNA, 32 nt, Human
ugguaggucuucucaccucgauggugcauaac

SEQ ID NO: 526581 - RNA, 32 nt, Human
ugguaggugaucucaggaauugcaggggaaag

SEQ ID NO: 526582 - RNA, 32 nt, Human
ugguaggugccuguaaucccagcuacuuggga

SEQ ID NO: 526583 - RNA, 32 nt, Human
ugguagguuguccugaauucuacauuauuaga

SEQ ID NO: 526584 - RNA, 32 nt, Human
ugguagguuguugcugucuguguuguugcugu

SEQ ID NO: 526585 - RNA, 32 nt, Human
ugguagguuucaucaggugguuaaagucguca

SEQ ID NO: 526586 - RNA, 32 nt, Human
ugguaguaaaacacagagggccaguaacgggu

SEQ ID NO: 526587 - RNA, 32 nt, Human
ugguaguaauuuccuguuuuccuugccuuuuu

SEQ ID NO: 526588 - RNA, 32 nt, Human
ugguaguacaauauuuuguuaggcguuucuga

SEQ ID NO: 526589 - RNA, 32 nt, Human
ugguaguacuccugcaaaauuuuauagcucag

SEQ ID NO: 526590 - RNA, 32 nt, Human
ugguaguaucuauuagagaugggggagggguu

SEQ ID NO: 526591 - RNA, 32 nt, Human
ugguagucacauagcagaaugaucagaguuac

SEQ ID NO: 526592 - RNA, 20 nt, Human
ugguagucagauauucaggg

SEQ ID NO: 526593 - RNA, 32 nt, Human
ugguaguccuuuucccuuucuccagucggccc

SEQ ID NO: 526594 - RNA, 18 nt, Human
ugguagucgcuggcccca

SEQ ID NO: 526595 - RNA, 32 nt, Human
ugguagucugcagggcugccucagguuuccua

SEQ ID NO: 526596 - RNA, 32 nt, Human
ugguagugaacagcagaucggucagcaccaga

SEQ ID NO: 526597 - RNA, 32 nt, Human
ugguagugacagaucugcaggacagauuuauc

SEQ ID NO: 526598 - RNA, 32 nt, Human
ugguagugcaacaguaacccaaaaaugucaau

SEQ ID NO: 526599 - RNA, 21 nt, Human
ugguagugcagaaagaaucca

SEQ ID NO: 526600 - RNA, 19 nt, Human
ugguagugccagggaccca

SEQ ID NO: 526601 - RNA, 31 nt, Human
ugguagugccucucugggcccugguuuaaaa

SEQ ID NO: 526602 - RNA, 21 nt, Human
ugguagugcugggcuguuccc

SEQ ID NO: 526603 - RNA, 20 nt, Human
ugguagugcugguggguuuu

SEQ ID NO: 526604 - RNA, 32 nt, Human
ugguagugguggcaguggugauggugguguug

SEQ ID NO: 526605 - RNA, 17 nt, Human
ugguagugguggguccc

SEQ ID NO: 526606 - RNA, 19 nt, Human
ugguaguguuggcgcuccu

SEQ ID NO: 526607 - RNA, 32 nt, Human
ugguaguuguggguugaagcacuggacaaugc

SEQ ID NO: 526608 - RNA, 32 nt, Human
ugguauaacucucagucagaggccaacggccu

SEQ ID NO: 526609 - RNA, 32 nt, Human
ugguauaaucaugccucacugcagccucggcu

SEQ ID NO: 526610 - RNA, 30 nt, Human
ugguauaguacuugacagaguaaauacuuc

SEQ ID NO: 526611 - RNA, 32 nt, Human
ugguauaguacuugacagaguaaauacuucau

SEQ ID NO: 526612 - RNA, 32 nt, Human
ugguauaugccugggagcagauuugcuggauc

SEQ ID NO: 526613 - RNA, 32 nt, Human
ugguauaugccuguagucccagcuacucagga

SEQ ID NO: 526614 - RNA, 32 nt, Human
ugguauaugcugggaacagggugcaggggcca

SEQ ID NO: 526615 - RNA, 32 nt, Human
ugguauauuaaaaggcacaagggcauuguggc

SEQ ID NO: 526616 - RNA, 18 nt, Human
ugguaucaccucaucuca

SEQ ID NO: 526617 - RNA, 32 nt, Human
ugguaucauugucuuuccugaaugacuuucua

SEQ ID NO: 526618 - RNA, 32 nt, Human
ugguauccuaucuuccuuuuguggacuucugc

SEQ ID NO: 526619 - RNA, 32 nt, Human
ugguauccuucuuggccaacagaugguaucuu

SEQ ID NO: 526620 - RNA, 32 nt, Human
ugguaucuaacuuugguucugaaguuuaugga

SEQ ID NO: 526621 - RNA, 32 nt, Human
ugguaucuacugcuccuuuuuacugccuucag

SEQ ID NO: 526622 - RNA, 32 nt, Human
ugguaucucaaggagguuucugagauagguag

SEQ ID NO: 526623 - RNA, 32 nt, Human
ugguaucucuagccuagaaucucguguguuag

SEQ ID NO: 526624 - RNA, 24 nt, Human
ugguaucucuucuuaguguucuau

SEQ ID NO: 526625 - RNA, 32 nt, Human
ugguaucugggcagaaguagcacagcucuugc

SEQ ID NO: 526626 - RNA, 22 nt, Human
ugguaucuucagcaguguuccg

SEQ ID NO: 526627 - RNA, 32 nt, Human
ugguaucuugcaggaacugugugcuaaaauug

SEQ ID NO: 526628 - RNA, 26 nt, Human
ugguaucuuuucaacuauuguuuuau

SEQ ID NO: 526629 - RNA, 32 nt, Human
ugguaugaaaauguguacauucccugugcaac

SEQ ID NO: 526630 - RNA, 32 nt, Human
ugguaugaagagaacguccacuuuaaggcuuu

SEQ ID NO: 526631 - RNA, 32 nt, Human
ugguaugaauccaggagguggagcuugcagug

SEQ ID NO: 526632 - RNA, 32 nt, Human
ugguaugagccgugcugcugggcacagccagg

SEQ ID NO: 526633 - RNA, 32 nt, Human
ugguaugaucacagcucacugcagcuuugauc

SEQ ID NO: 526634 - RNA, 32 nt, Human
ugguaugaucacggcucacugcagccucaacc

SEQ ID NO: 526635 - RNA, 32 nt, Human
ugguaugaucauagcugacugcagccucaacc

SEQ ID NO: 526636 - RNA, 32 nt, Human
ugguaugaucauggcuugcugcagccucaacc

SEQ ID NO: 526637 - RNA, 32 nt, Human
ugguaugaucucagcucacugcagccucugcc

SEQ ID NO: 526638 - RNA, 32 nt, Human
ugguaugaucuuggcucacugcagccucugcc

SEQ ID NO: 526639 - RNA, 32 nt, Human
ugguaugaugggaacugcccuuuucaccugcc

SEQ ID NO: 526640 - RNA, 21 nt, Human
ugguaugcaccuguaauccca

SEQ ID NO: 526641 - RNA, 32 nt, Human
ugguaugcaccuguaaucccagcuacucggga

SEQ ID NO: 526642 - RNA, 21 nt, Human
ugguaugccccuguaguccca

SEQ ID NO: 526643 - RNA, 32 nt, Human
ugguauggaagguggagcguucaccagugacc

SEQ ID NO: 526644 - RNA, 32 nt, Human
ugguauggcucugaggcucccuggggccugcu

SEQ ID NO: 526645 - RNA, 32 nt, Human
ugguauggucagaauauaauacuuccauaauu

SEQ ID NO: 526646 - RNA, 32 nt, Human
ugguaugguggucaccuuugcuccagucaacg

SEQ ID NO: 526647 - RNA, 21 nt, Human
ugguaugugccuguaauccca

SEQ ID NO: 526648 - RNA, 32 nt, Human
ugguaugugccuguaaucccagcuacuuggga

SEQ ID NO: 526649 - RNA, 21 nt, Human
ugguaugugccuguaguccca

SEQ ID NO: 526650 - RNA, 32 nt, Human
ugguaugugcuagaacaaugggaggcugugau

SEQ ID NO: 526651 - RNA, 32 nt, Human
ugguaugugggaagaaguucagaggaaccguu

SEQ ID NO: 526652 - RNA, 19 nt, Human
ugguaugugggugguccca

SEQ ID NO: 526653 - RNA, 32 nt, Human
ugguaugugguguaauguugauugggaauaag

SEQ ID NO: 526654 - RNA, 32 nt, Human
ugguauuaggagguggggccuuugggauguga

SEQ ID NO: 526655 - RNA, 32 nt, Human
ugguauucuccucuuuaccugguagggaucuu

SEQ ID NO: 526656 - RNA, 19 nt, Human
ugguauugaucuuuucaca

SEQ ID NO: 526657 - RNA, 32 nt, Human
ugguauuguaacauuuaugcucuaauaucaac

SEQ ID NO: 526658 - RNA, 32 nt, Human
ugguauuguugucacuaagccagaccugauca

SEQ ID NO: 526659 - RNA, 32 nt, Human
ugguauuuacugcaaugucugucccuaaacau

SEQ ID NO: 526660 - RNA, 32 nt, Human
ugguauuuacuuuuguuccugcguuacuuugc

SEQ ID NO: 526661 - RNA, 32 nt, Human
ugguauuugccugggccaggaaaggauaagaa

SEQ ID NO: 526662 - RNA, 24 nt, Human
ugguauuuuuuauuaagccuccau

SEQ ID NO: 526663 - RNA, 32 nt, Human
uggucaaaaagcuccuuggggcaugaaggccg

SEQ ID NO: 526664 - RNA, 32 nt, Human
uggucaaacacuagucuggacauggugguaaa

SEQ ID NO: 526665 - RNA, 32 nt, Human
uggucaaacccagcaacccuuggccagaacuu

SEQ ID NO: 526666 - RNA, 32 nt, Human
uggucaaagcccccaguauagcccauuccugu

SEQ ID NO: 526667 - RNA, 32 nt, Human
uggucaaauuggaagcccagggccaggacccg

SEQ ID NO: 526668 - RNA, 32 nt, Human
uggucaacauagugaaaccccgucucuaauaa

SEQ ID NO: 526669 - RNA, 32 nt, Human
uggucaacauggcaaaacccugucucuacaaa

SEQ ID NO: 526670 - RNA, 32 nt, Human
uggucaacauggcaaaagcccaucucuacuaa

SEQ ID NO: 526671 - RNA, 32 nt, Human
uggucaacauggcgaaaccccaucucuacuaa

SEQ ID NO: 526672 - RNA, 32 nt, Human
uggucaacauggcgaaaccccaucucuacuga

SEQ ID NO: 526673 - RNA, 32 nt, Human
uggucaacauggcgaaacccugucucuacaaa

SEQ ID NO: 526674 - RNA, 32 nt, Human
uggucaacauggcgaaacccugucucuacuaa

SEQ ID NO: 526675 - RNA, 32 nt, Human
uggucaacauggcgaaaucccgucucuacuaa

SEQ ID NO: 526676 - RNA, 32 nt, Human
uggucaacauggugaaaccccaucuccacuaa

SEQ ID NO: 526677 - RNA, 32 nt, Human
uggucaacauggugaaaccccaucucuacuaa

SEQ ID NO: 526678 - RNA, 32 nt, Human
uggucaacauggugaaaccccgucuccacuaa

SEQ ID NO: 526679 - RNA, 32 nt, Human
uggucaacauggugaaaccccgucucuacuaa

SEQ ID NO: 526680 - RNA, 32 nt, Human
uggucaacaugguguaaccccaucucuacuaa

SEQ ID NO: 526681 - RNA, 32 nt, Human
uggucaacccaggagcaguguccuacaccgcc

SEQ ID NO: 526682 - RNA, 32 nt, Human
uggucaaccucuagugagagcucucuuccugg

SEQ ID NO: 526683 - RNA, 32 nt, Human
uggucaacgggagggaggaggagcagacggca

SEQ ID NO: 526684 - RNA, 32 nt, Human
uggucaacucacaccugccucuucugcagccu

SEQ ID NO: 526685 - RNA, 32 nt, Human
uggucaacuggguucacucaucaacucauucc

SEQ ID NO: 526686 - RNA, 32 nt, Human
uggucaacuugguaaaaccccgucucuacuaa

SEQ ID NO: 526687 - RNA, 32 nt, Human
uggucaagauggugaaaccccaucucuacuaa

SEQ ID NO: 526688 - RNA, 32 nt, Human
uggucaaggagagggagagagagguaaggguc

SEQ ID NO: 526689 - RNA, 32 nt, Human
uggucaaguggaggggacgggaaaaagcuaug

SEQ ID NO: 526690 - RNA, 32 nt, Human
uggucaaguucaguuuuagaaaagggagucug

SEQ ID NO: 526691 - RNA, 32 nt, Human
uggucaauauggugaaaccccaucucuacuaa

SEQ ID NO: 526692 - RNA, 32 nt, Human
uggucacaaaccugcauggggacauggacaag

SEQ ID NO: 526693 - RNA, 32 nt, Human
uggucacaaguacauuaaggcacguagaaggu

SEQ ID NO: 526694 - RNA, 32 nt, Human
uggucacaaguuaucccuccucaguaugaaaa

SEQ ID NO: 526695 - RNA, 32 nt, Human
uggucacacaucuguaagugggagaggcagga

SEQ ID NO: 526696 - RNA, 32 nt, Human
uggucacaccacugcacuccagccugggcaau

SEQ ID NO: 526697 - RNA, 32 nt, Human
uggucacaccacuguauuccagccugggugac

SEQ ID NO: 526698 - RNA, 32 nt, Human
uggucacagcuacucagaaggcugagguggga

SEQ ID NO: 526699 - RNA, 32 nt, Human
uggucacaggccuggcaucccugcugcuccuc

SEQ ID NO: 526700 - RNA, 32 nt, Human
uggucacagggagggcucagaggagccugacu

SEQ ID NO: 526701 - RNA, 32 nt, Human
uggucacagucaacuauccuccgaccaucacg

SEQ ID NO: 526702 - RNA, 32 nt, Human
uggucacaucacagcagucucagcgaucgaua

SEQ ID NO: 526703 - RNA, 32 nt, Human
uggucacaugagucugucuccuuacuuuaguc

SEQ ID NO: 526704 - RNA, 32 nt, Human
uggucaccagaggcacagaagccagaugcgug

SEQ ID NO: 526705 - RNA, 32 nt, Human
uggucaccagcuccucccuuguucucuaaguu

SEQ ID NO: 526706 - RNA, 32 nt, Human
uggucaccccucucuccuccuggggcuggggc

SEQ ID NO: 526707 - RNA, 32 nt, Human
uggucacccugagagucccaucgccugcagca

SEQ ID NO: 526708 - RNA, 32 nt, Human
uggucacccuggacaaggagguaaccacccca

SEQ ID NO: 526709 - RNA, 32 nt, Human
uggucaccuccugccuggaaucuugccaucag

SEQ ID NO: 526710 - RNA, 32 nt, Human
uggucacggugcugaggaaccuccucaucagc

SEQ ID NO: 526711 - RNA, 32 nt, Human
uggucacucccuggcccugaccugagcccggg

SEQ ID NO: 526712 - RNA, 32 nt, Human
uggucacugaaugcacucccugguuuuuauuu

SEQ ID NO: 526713 - RNA, 32 nt, Human
uggucacugagugcucuaauaguaaggagaaa

SEQ ID NO: 526714 - RNA, 18 nt, Human
uggucacugaugauucca

SEQ ID NO: 526715 - RNA, 32 nt, Human
uggucacugcaaccuccaucucccuggcucaa

SEQ ID NO: 526716 - RNA, 32 nt, Human
uggucacugcaaccucugccuccuggguucaa

SEQ ID NO: 526717 - RNA, 32 nt, Human
uggucacugcacuccagccuggcuacagagug

SEQ ID NO: 526718 - RNA, 32 nt, Human
uggucacugcuggcccuagcauuggacccuag

SEQ ID NO: 526719 - RNA, 32 nt, Human
uggucacuggaacaucauaagggaaaacuuua

SEQ ID NO: 526720 - RNA, 32 nt, Human
uggucacuucaaacaugcccucaggcuugggg

SEQ ID NO: 526721 - RNA, 32 nt, Human
uggucacuuugauuuuucaaaggugacaauug

SEQ ID NO: 526722 - RNA, 32 nt, Human
uggucagaaauggauggauucuggaaauauuu

SEQ ID NO: 526723 - RNA, 20 nt, Human
uggucagaagucccagugag

SEQ ID NO: 526724 - RNA, 32 nt, Human
uggucagaagugacauaugccaacacgggguc

SEQ ID NO: 526725 - RNA, 32 nt, Human
uggucagaauuuucucacccuaguacuccuac

SEQ ID NO: 526726 - RNA, 32 nt, Human
uggucagacucugggacuccugagaugggaga

SEQ ID NO: 526727 - RNA, 32 nt, Human
uggucagaggccggggcuagaggcagauggaa

SEQ ID NO: 526728 - RNA, 30 nt, Human
uggucagauuuguuguaagaaagacugugc

SEQ ID NO: 526729 - RNA, 32 nt, Human
uggucagcagcccagaccccaucaggggagag

SEQ ID NO: 526730 - RNA, 32 nt, Human
uggucagcagugaccccagcagagcaggcccc

SEQ ID NO: 526731 - RNA, 32 nt, Human
uggucagcaguggccacaaggcugcuuucugc

SEQ ID NO: 526732 - RNA, 32 nt, Human
uggucagcaguucuaagagacacugcccacau

SEQ ID NO: 526733 - RNA, 32 nt, Human
uggucagcaucaggguccccagccucugggcu

SEQ ID NO: 526734 - RNA, 32 nt, Human
uggucagcauggcaaaaccccgucucuacuaa

SEQ ID NO: 526735 - RNA, 32 nt, Human
uggucagccagccaggcuagucccacauaccu

SEQ ID NO: 526736 - RNA, 32 nt, Human
uggucagccccacuccagcacggggugaacgg

SEQ ID NO: 526737 - RNA, 32 nt, Human
uggucagccccuccugggagggcacagccgua

SEQ ID NO: 526738 - RNA, 32 nt, Human
uggucagcccugcuuucugcagcuggaagccu

SEQ ID NO: 526739 - RNA, 18 nt, Human
uggucagccuaggugaga

SEQ ID NO: 526740 - RNA, 32 nt, Human
uggucagcuaauugcuuugacaacagcgcagu

SEQ ID NO: 526741 - RNA, 32 nt, Human
uggucagcuacacaaccuggaucuuaccacag

SEQ ID NO: 526742 - RNA, 21 nt, Human
uggucagcucaggcccuccua

SEQ ID NO: 526743 - RNA, 32 nt, Human
uggucagcuguggugggcugcuccccggagcu

SEQ ID NO: 526744 - RNA, 32 nt, Human
uggucaggacagagacaaaaaugaggaaaacu

SEQ ID NO: 526745 - RNA, 32 nt, Human
uggucaggacaguggggguuggggguggggug

SEQ ID NO: 526746 - RNA, 32 nt, Human
uggucaggagggucgcugcuguggaagggguc

SEQ ID NO: 526747 - RNA, 32 nt, Human
uggucaggcccagcacauccagccuggcaucc

SEQ ID NO: 526748 - RNA, 32 nt, Human
uggucaggcccagccaauggaacggaauggaa

SEQ ID NO: 526749 - RNA, 32 nt, Human
uggucaggcccaggcugagugagaugagcugc

SEQ ID NO: 526750 - RNA, 32 nt, Human
uggucaggcuccugcaggauaaguggccacca

SEQ ID NO: 526751 - RNA, 32 nt, Human
uggucaggcuggucucaaaccccugaccucag

SEQ ID NO: 526752 - RNA, 32 nt, Human
uggucagggauugggcugcuucuucaguuccu

SEQ ID NO: 526753 - RNA, 32 nt, Human
uggucagggcucaggcuucacuuuguaaacca

SEQ ID NO: 526754 - RNA, 32 nt, Human
uggucagggcuggucuugaacuccugagcuca

SEQ ID NO: 526755 - RNA, 32 nt, Human
uggucagggggcccugaaaacacugguaauau

SEQ ID NO: 526756 - RNA, 32 nt, Human
uggucagggugaggauggugagggagggcugg

SEQ ID NO: 526757 - RNA, 32 nt, Human
uggucaggucccauguugucccugcugccucc

SEQ ID NO: 526758 - RNA, 32 nt, Human
uggucaggugccucaguaaaucacagacccag

SEQ ID NO: 526759 - RNA, 32 nt, Human
uggucaguauucuuuuggaauguaaaccgauu

SEQ ID NO: 526760 - RNA, 32 nt, Human
uggucagucacgcaguugaggucagggaagga

SEQ ID NO: 526761 - RNA, 32 nt, Human
uggucaguccuccugaacauucaggaaaucaa

SEQ ID NO: 526762 - RNA, 32 nt, Human
uggucagucugaaagggaggcucucuuaagag

SEQ ID NO: 526763 - RNA, 32 nt, Human
uggucagugggacauuuugucaacuaugggua

SEQ ID NO: 526764 - RNA, 32 nt, Human
uggucagugggggucagccaggagcccaggga

SEQ ID NO: 526765 - RNA, 32 nt, Human
uggucaguuagacauacguugguuuccaggau

SEQ ID NO: 526766 - RNA, 32 nt, Human
uggucaguucucucaacuuugcuuugggcaag

SEQ ID NO: 526767 - RNA, 32 nt, Human
uggucauaccaccgcacuccagccugagcaac

SEQ ID NO: 526768 - RNA, 32 nt, Human
uggucauacgggucaguagggauaagaauugu

SEQ ID NO: 526769 - RNA, 32 nt, Human
uggucauagagagagaaggaccuuugacuuuu

SEQ ID NO: 526770 - RNA, 32 nt, Human
uggucauagcaucuaucuccuuugccuuaauu

SEQ ID NO: 526771 - RNA, 28 nt, Human
uggucaucaggagcugccucuucuguua

SEQ ID NO: 526772 - RNA, 32 nt, Human
uggucaucaguaucauuagugaaaaagaaaca

SEQ ID NO: 526773 - RNA, 32 nt, Human
uggucaugacacugcccuccagccuggacaac

SEQ ID NO: 526774 - RNA, 32 nt, Human
uggucaugagagcugggguggggaaggauugu

SEQ ID NO: 526775 - RNA, 32 nt, Human
uggucaugccacugcacuccagccugggcaac

SEQ ID NO: 526776 - RNA, 20 nt, Human
uggucaugccuguaauccca

SEQ ID NO: 526777 - RNA, 32 nt, Human
uggucaugccuguaaucccagcauuuuggaag

SEQ ID NO: 526778 - RNA, 32 nt, Human
uggucaugcuccagugugacucugguacccuu

SEQ ID NO: 526779 - RNA, 21 nt, Human
uggucaugcucucagcuccac

SEQ ID NO: 526780 - RNA, 32 nt, Human
uggucaugcuucugaagcugcucaccuggccg

SEQ ID NO: 526781 - RNA, 32 nt, Human
uggucaugcuuuggagaucaaauauugguuga

SEQ ID NO: 526782 - RNA, 32 nt, Human
uggucauggcaucaaggcucacugcagccugg

SEQ ID NO: 526783 - RNA, 24 nt, Human
uggucaugguggcucacgccugua

SEQ ID NO: 526784 - RNA, 21 nt, Human
uggucaugguggcucaugccu

SEQ ID NO: 526785 - RNA, 19 nt, Human
uggucaugguggugugcgc

SEQ ID NO: 526786 - RNA, 19 nt, Human
uggucauggugguguucac

SEQ ID NO: 526787 - RNA, 32 nt, Human
uggucauguggacauuuccagaaaagcauuau

SEQ ID NO: 526788 - RNA, 32 nt, Human
uggucauguuggucuuuguaacaaaucaaaau

SEQ ID NO: 526789 - RNA, 32 nt, Human
uggucauucaguuuaaaugaauggguauacug

SEQ ID NO: 526790 - RNA, 32 nt, Human
uggucauugccuugccaaacaggagcuccagc

SEQ ID NO: 526791 - RNA, 32 nt, Human
uggucauuggauuuaaaggccaccuggguaau

SEQ ID NO: 526792 - RNA, 32 nt, Human
uggucauugguguuugcucuugccucuccucc

SEQ ID NO: 526793 - RNA, 32 nt, Human
uggucauuuuucuucuuguggccucuggaaug

SEQ ID NO: 526794 - RNA, 32 nt, Human
ugguccaacagguguccugggucuggggccac

SEQ ID NO: 526795 - RNA, 32 nt, Human
ugguccaaguaguggaggagguuuuguagauu

SEQ ID NO: 526796 - RNA, 32 nt, Human
ugguccacagcacuccauucuggguggcagag

SEQ ID NO: 526797 - RNA, 32 nt, Human
ugguccacagggcaccugccacccugggccug

SEQ ID NO: 526798 - RNA, 32 nt, Human
ugguccaccaaccagacccuuggaaaggaaua

SEQ ID NO: 526799 - RNA, 32 nt, Human
ugguccaccuggcagauucugaccucaccugg

SEQ ID NO: 526800 - RNA, 32 nt, Human
ugguccacggccguacaauccccagcccuucc

SEQ ID NO: 526801 - RNA, 32 nt, Human
ugguccacucugcucugagcagccugggaugc

SEQ ID NO: 526802 - RNA, 32 nt, Human
ugguccacugccuuuucauauguguuguuucu

SEQ ID NO: 526803 - RNA, 32 nt, Human
ugguccagaaacuccuguuucuccuuaguugg

SEQ ID NO: 526804 - RNA, 32 nt, Human
ugguccagacuugccacauacuagguuaaaga

SEQ ID NO: 526805 - RNA, 32 nt, Human
ugguccagaggagggaggaggaagggaagacc

SEQ ID NO: 526806 - RNA, 32 nt, Human
ugguccagauagacucuuuuuaaggaucuugg

SEQ ID NO: 526807 - RNA, 32 nt, Human
ugguccagcuucuguggaaaagaaggauugcc

SEQ ID NO: 526808 - RNA, 22 nt, Human
ugguccaggagauaccagcaga

SEQ ID NO: 526809 - RNA, 32 nt, Human
ugguccaggcaggcggggaugugcggugacca

SEQ ID NO: 526810 - RNA, 32 nt, Human
ugguccaggggguguggcucaguggcuggugg

SEQ ID NO: 526811 - RNA, 32 nt, Human
ugguccaggguaagaaugggaucgguggagag

SEQ ID NO: 526812 - RNA, 32 nt, Human
ugguccagguucuucuagaugucugcacaaau

SEQ ID NO: 526813 - RNA, 32 nt, Human
ugguccaguacuuccugaagcagaucaacaaa

SEQ ID NO: 526814 - RNA, 32 nt, Human
ugguccagucaaggugacagagacaacgugac

SEQ ID NO: 526815 - RNA, 18 nt, Human
ugguccagucucccagca

SEQ ID NO: 526816 - RNA, 32 nt, Human
ugguccaguucugcaccgggguggggcuggga

SEQ ID NO: 526817 - RNA, 32 nt, Human
ugguccauacagagaaacugugguccuuuaua

SEQ ID NO: 526818 - RNA, 32 nt, Human
ugguccauagggcucucucagggagagagcag

SEQ ID NO: 526819 - RNA, 32 nt, Human
ugguccaucaaauuacaacagccaagauuaca

SEQ ID NO: 526820 - RNA, 32 nt, Human
ugguccauccuccaggcauccauguccaccau

SEQ ID NO: 526821 - RNA, 21 nt, Human
ugguccaugaugucaucaggc

SEQ ID NO: 526822 - RNA, 31 nt, Human
ugguccaugcuuuucugacguucucagaaua

SEQ ID NO: 526823 - RNA, 32 nt, Human
ugguccauggccaggauucugugcuucagaac

SEQ ID NO: 526824 - RNA, 32 nt, Human
uggucccaacuacuugggaggcugcaccagga

SEQ ID NO: 526825 - RNA, 32 nt, Human
uggucccacagcuggguuccaccugaagagcc

SEQ ID NO: 526826 - RNA, 32 nt, Human
uggucccaccgcacuccagccugggcaacaga

SEQ ID NO: 526827 - RNA, 32 nt, Human
uggucccacgccgccucugcucagaccacugu

SEQ ID NO: 526828 - RNA, 32 nt, Human
uggucccacugcagcugcccagucuuccaucu

SEQ ID NO: 526829 - RNA, 32 nt, Human
uggucccagagggagaggaggugggcugugcc

SEQ ID NO: 526830 - RNA, 32 nt, Human
uggucccagauggccagguguacugggugacc

SEQ ID NO: 526831 - RNA, 32 nt, Human
uggucccagcacuuugggaggccgagguggau

SEQ ID NO: 526832 - RNA, 32 nt, Human
uggucccagcacuuugggaggcugaggugggu

SEQ ID NO: 526833 - RNA, 32 nt, Human
uggucccagcagaagugacuggcggggaccag

SEQ ID NO: 526834 - RNA, 32 nt, Human
uggucccagccgcucgggaggcugaggcagga

SEQ ID NO: 526835 - RNA, 32 nt, Human
uggucccagcuacaggggaggcugagacgcaa

SEQ ID NO: 526836 - RNA, 32 nt, Human
uggucccagcuacaugggaggcugaggcagga

SEQ ID NO: 526837 - RNA, 32 nt, Human
uggucccagcuacccgggaggcugaguuggga

SEQ ID NO: 526838 - RNA, 32 nt, Human
uggucccagcuacuagggaggcugagccagga

SEQ ID NO: 526839 - RNA, 32 nt, Human
uggucccagcuacucaacaggcugagguuggg

SEQ ID NO: 526840 - RNA, 32 nt, Human
uggucccagcuacucaagaggcugaggugaga

SEQ ID NO: 526841 - RNA, 32 nt, Human
uggucccagcuacucagagggcugagguggga

SEQ ID NO: 526842 - RNA, 32 nt, Human
uggucccagcuacucaggaggcugaggcagaa

SEQ ID NO: 526843 - RNA, 32 nt, Human
uggucccagcuacucaggaggcugaggcugga

SEQ ID NO: 526844 - RNA, 32 nt, Human
uggucccagcuacucaggaggcugagguggaa

SEQ ID NO: 526845 - RNA, 32 nt, Human
uggucccagcuacucaggaggcugagguggga

SEQ ID NO: 526846 - RNA, 32 nt, Human
uggucccagcuacuccagaggcugagguggga

SEQ ID NO: 526847 - RNA, 32 nt, Human
uggucccagcuacucgggaggcugaggcacaa

SEQ ID NO: 526848 - RNA, 32 nt, Human
uggucccagcuacucgggaggcugaggcagga

SEQ ID NO: 526849 - RNA, 32 nt, Human
uggucccagcuacucgggaggcugagggggaa

SEQ ID NO: 526850 - RNA, 32 nt, Human
uggucccagcuacucgggaggcugagguggga

SEQ ID NO: 526851 - RNA, 32 nt, Human
uggucccagcuacucgggaggcugugguggga

SEQ ID NO: 526852 - RNA, 32 nt, Human
uggucccagcuacucuggaggcuaagguggga

SEQ ID NO: 526853 - RNA, 32 nt, Human
uggucccagcuacucuggaggcugaggcggaa

SEQ ID NO: 526854 - RNA, 32 nt, Human
uggucccagcuacucuggaggcugagguggga

SEQ ID NO: 526855 - RNA, 32 nt, Human
uggucccagcuacugaggaggcugagguggga

SEQ ID NO: 526856 - RNA, 32 nt, Human
uggucccagcuacuggggaggcugaggcagga

SEQ ID NO: 526857 - RNA, 32 nt, Human
uggucccagcuacuggggaggcugagguggga

SEQ ID NO: 526858 - RNA, 32 nt, Human
uggucccagcuacuugagaggcugagguggga

SEQ ID NO: 526859 - RNA, 32 nt, Human
uggucccagcuacuugggaggcugagguggga

SEQ ID NO: 526860 - RNA, 32 nt, Human
uggucccagcuagccgguaggcugagguggga

SEQ ID NO: 526861 - RNA, 32 nt, Human
uggucccagcuauucaggaggcugagguggga

SEQ ID NO: 526862 - RNA, 32 nt, Human
uggucccagcuauucgggaggcugaggcagga

SEQ ID NO: 526863 - RNA, 32 nt, Human
uggucccagcuauuugggaggcugagguggga

SEQ ID NO: 526864 - RNA, 32 nt, Human
uggucccagcucccaaggagguugcagaagua

SEQ ID NO: 526865 - RNA, 32 nt, Human
uggucccagcuccucaggaggcugagguggga

SEQ ID NO: 526866 - RNA, 32 nt, Human
uggucccagcugcucgggaggcugagcaggag

SEQ ID NO: 526867 - RNA, 32 nt, Human
uggucccagcugcucgggaggcugaggcagga

SEQ ID NO: 526868 - RNA, 32 nt, Human
uggucccagcugcuggggaggcugagguggga

SEQ ID NO: 526869 - RNA, 32 nt, Human
uggucccagcugcuugggaggcugaggcagga

SEQ ID NO: 526870 - RNA, 32 nt, Human
uggucccagcuucuugggaggcugagguggga

SEQ ID NO: 526871 - RNA, 32 nt, Human
uggucccaggagaaggucugggggucacuagc

SEQ ID NO: 526872 - RNA, 32 nt, Human
uggucccaggaguucaagaccagccuguggaa

SEQ ID NO: 526873 - RNA, 32 nt, Human
uggucccagguacuugagaggcugaggcagga

SEQ ID NO: 526874 - RNA, 32 nt, Human
uggucccagguacuugggaggcugagguggga

SEQ ID NO: 526875 - RNA, 32 nt, Human
uggucccagguuucuccaucccuucuuccuuu

SEQ ID NO: 526876 - RNA, 32 nt, Human
uggucccaguuacucggaaggcugaggugggc

SEQ ID NO: 526877 - RNA, 32 nt, Human
uggucccaguuacuugggaggcugacgugggu

SEQ ID NO: 526878 - RNA, 32 nt, Human
uggucccaguuucuugggaggcugaggcggga

SEQ ID NO: 526879 - RNA, 32 nt, Human
uggucccaucugcuugggaggcugagguugca

SEQ ID NO: 526880 - RNA, 32 nt, Human
uggucccaucuucugcccgcuccuccaggaaa

SEQ ID NO: 526881 - RNA, 32 nt, Human
ugguccccaaaccaaagaguugccugcagguu

SEQ ID NO: 526882 - RNA, 32 nt, Human
ugguccccaaccacaguccuggugaagaugug

SEQ ID NO: 526883 - RNA, 32 nt, Human
ugguccccacacccccagguuggguggguuuu

SEQ ID NO: 526884 - RNA, 32 nt, Human
ugguccccaucccugucucucccuuucacccu

SEQ ID NO: 526885 - RNA, 32 nt, Human
uggucccccagccucucuugggcuuucuuaca

SEQ ID NO: 526886 - RNA, 32 nt, Human
ugguccccgugguugaauuggaagaggccaua

SEQ ID NO: 526887 - RNA, 32 nt, Human
ugguccccuaaacaaucucuuccucagccagc

SEQ ID NO: 526888 - RNA, 32 nt, Human
ugguccccuccucugcuuuagccccggcaagc

SEQ ID NO: 526889 - RNA, 32 nt, Human
ugguccccugcucugcccucgugcuuugcugg

SEQ ID NO: 526890 - RNA, 32 nt, Human
ugguccccuuaaaugccaaucuuccauauuag

SEQ ID NO: 526891 - RNA, 32 nt, Human
ugguccccuuucucccuccugcuucucaccug

SEQ ID NO: 526892 - RNA, 32 nt, Human
uggucccggcugcucgggaggcugaggcaggg

SEQ ID NO: 526893 - RNA, 32 nt, Human
uggucccggcugcuuggaaggcugaggcgggg

SEQ ID NO: 526894 - RNA, 32 nt, Human
uggucccgguuacucaggaggcugaggcagaa

SEQ ID NO: 526895 - RNA, 32 nt, Human
uggucccuaagaucaaaccccauggagcagcc

SEQ ID NO: 526896 - RNA, 32 nt, Human
uggucccuaugggcuuccgcacaugccgcggg

SEQ ID NO: 526897 - RNA, 22 nt, Human
uggucccucacccaggccucca

SEQ ID NO: 526898 - RNA, 32 nt, Human
uggucccuccacuaggaguuaacuacccuaca

SEQ ID NO: 526899 - RNA, 32 nt, Human
uggucccuccauuccucuucaggcaucuggag

SEQ ID NO: 526900 - RNA, 32 nt, Human
uggucccucccagacaagcaaggccucugauu

SEQ ID NO: 526901 - RNA, 32 nt, Human
uggucccucugugcuucucucuuucuccuccc

SEQ ID NO: 526902 - RNA, 32 nt, Human
uggucccugagcaucccaggaggccgacugua

SEQ ID NO: 526903 - RNA, 32 nt, Human
uggucccugcaagcguccgcuuuccuggccaa

SEQ ID NO: 526904 - RNA, 32 nt, Human
uggucccugcagcccuucccagacacagaguu

SEQ ID NO: 526905 - RNA, 32 nt, Human
uggucccugcccuccccugcucccagguugag

SEQ ID NO: 526906 - RNA, 32 nt, Human
uggucccugccuggcugagguggcagcagggg

SEQ ID NO: 526907 - RNA, 32 nt, Human
uggucccugcuuucucuuucucuuucucugug

SEQ ID NO: 526908 - RNA, 32 nt, Human
uggucccuggcaacaggaaccugggcagcuua

SEQ ID NO: 526909 - RNA, 32 nt, Human
uggucccuggggauggggcggcgguagcagcu

SEQ ID NO: 526910 - RNA, 32 nt, Human
uggucccugucucccuucuuguacaauccaga

SEQ ID NO: 526911 - RNA, 32 nt, Human
uggucccuguggucccagcuacucuggaggcu

SEQ ID NO: 526912 - RNA, 32 nt, Human
uggucccuugauacauuguccuuuaccucaca

SEQ ID NO: 526913 - RNA, 32 nt, Human
ugguccgcagaggcccuccugugcgccacuug

SEQ ID NO: 526914 - RNA, 32 nt, Human
ugguccgccgcuaccuucaccaccuccugcug

SEQ ID NO: 526915 - RNA, 32 nt, Human
ugguccggacucagcaucauuuuggaggcuga

SEQ ID NO: 526916 - RNA, 22 nt, Human
ugguccgucgcucgccugggug

SEQ ID NO: 526917 - RNA, 32 nt, Human
ugguccguguguggccuagcucauuccauguc

SEQ ID NO: 526918 - RNA, 32 nt, Human
ugguccuagagaaaagacuaugucauuuacug

SEQ ID NO: 526919 - RNA, 32 nt, Human
ugguccuagaggaagcauuggggugggggagg

SEQ ID NO: 526920 - RNA, 32 nt, Human
ugguccuagccucuuggagggcugagguggga

SEQ ID NO: 526921 - RNA, 32 nt, Human
ugguccuagcuacucaggaggcugaggcagga

SEQ ID NO: 526922 - RNA, 32 nt, Human
ugguccuagcuacucgggaggcugaggcagga

SEQ ID NO: 526923 - RNA, 32 nt, Human
ugguccuagcuacuugggaggcugaaguggga

SEQ ID NO: 526924 - RNA, 32 nt, Human
ugguccuagcuacuugggaggcugagguguga

SEQ ID NO: 526925 - RNA, 32 nt, Human
ugguccuagcuauucaggaaacugagguggga

SEQ ID NO: 526926 - RNA, 32 nt, Human
ugguccuagcuauucaggaggcugacauagga

SEQ ID NO: 526927 - RNA, 32 nt, Human
ugguccuagcuccucgggaggcugaggcagga

SEQ ID NO: 526928 - RNA, 32 nt, Human
ugguccuagggagggcggaaagggaggcacug

SEQ ID NO: 526929 - RNA, 32 nt, Human
ugguccuagggugggaaggggcuagggaggac

SEQ ID NO: 526930 - RNA, 32 nt, Human
ugguccucagggucuccggccucggcacauua

SEQ ID NO: 526931 - RNA, 32 nt, Human
ugguccucaucuuggucccuuccaaucugaaa

SEQ ID NO: 526932 - RNA, 32 nt, Human
ugguccucaucuuuacuuaaaaagcucuuaua

SEQ ID NO: 526933 - RNA, 32 nt, Human
ugguccucauguuucuggguaaggaagagacc

SEQ ID NO: 526934 - RNA, 32 nt, Human
ugguccucauuuuucuuuuggugcagaaccgu

SEQ ID NO: 526935 - RNA, 32 nt, Human
ugguccucccaaagugcugggauuaauggcgu

SEQ ID NO: 526936 - RNA, 32 nt, Human
ugguccuccucgcuauguuggaaaugugcaac

SEQ ID NO: 526937 - RNA, 32 nt, Human
ugguccuccugccucagccucccacaggaucg

SEQ ID NO: 526938 - RNA, 32 nt, Human
ugguccuccugccucagcuuccaaaggcacag

SEQ ID NO: 526939 - RNA, 32 nt, Human
ugguccucggugguuaucugcagcuuguuaau

SEQ ID NO: 526940 - RNA, 32 nt, Human
ugguccucuagaugggcacgaaugccauuggc

SEQ ID NO: 526941 - RNA, 32 nt, Human
ugguccucuggguuuccaggaaauugucuagc

SEQ ID NO: 526942 - RNA, 32 nt, Human
ugguccucugugccugguggggugggggugcc

SEQ ID NO: 526943 - RNA, 32 nt, Human
ugguccucuuucuccaacaccuagccugagac

SEQ ID NO: 526944 - RNA, 32 nt, Human
ugguccugaccaucuggggcacgagggccugg

SEQ ID NO: 526945 - RNA, 32 nt, Human
ugguccugagucaggagguugaggcugcagug

SEQ ID NO: 526946 - RNA, 32 nt, Human
ugguccugauguccuuugaggcuucuuuagcu

SEQ ID NO: 526947 - RNA, 32 nt, Human
ugguccugauugaauagaagaccccagagguu

SEQ ID NO: 526948 - RNA, 32 nt, Human
ugguccugcacugggggcuggaacacagacuu

SEQ ID NO: 526949 - RNA, 32 nt, Human
ugguccugcacugucccggagcucaggcccug

SEQ ID NO: 526950 - RNA, 32 nt, Human
ugguccugcccuucucccugcaugccuguggg

SEQ ID NO: 526951 - RNA, 32 nt, Human
ugguccuggcaucugcuguacaugucuguagg

SEQ ID NO: 526952 - RNA, 32 nt, Human
ugguccuggccacgcaguaccugccaagggcu

SEQ ID NO: 526953 - RNA, 32 nt, Human
ugguccuggccuccaccugcccucucuucccu

SEQ ID NO: 526954 - RNA, 32 nt, Human
ugguccuggcugugcugcugcaccagggccgc

SEQ ID NO: 526955 - RNA, 32 nt, Human
ugguccugggaagcaagcacuuuuccauuucc

SEQ ID NO: 526956 - RNA, 32 nt, Human
ugguccugggcuguggguaggggcuagggccg

SEQ ID NO: 526957 - RNA, 32 nt, Human
ugguccugggggcuggggcuggagaggccgcu

SEQ ID NO: 526958 - RNA, 32 nt, Human
ugguccugguguggacuacugugggagcaggg

SEQ ID NO: 526959 - RNA, 32 nt, Human
ugguccugguuauggguuauggagagggcugc

SEQ ID NO: 526960 - RNA, 32 nt, Human
ugguccuguacccagaggucccagggaucggc

SEQ ID NO: 526961 - RNA, 32 nt, Human
ugguccuguucuaugguggggcucccuugcca

SEQ ID NO: 526962 - RNA, 32 nt, Human
ugguccuguugaucccagucucugccagacca

SEQ ID NO: 526963 - RNA, 32 nt, Human
ugguccuuagccccaugccucuuccaaaacag

SEQ ID NO: 526964 - RNA, 32 nt, Human
ugguccuucaguauuucugaauacuuagucua

SEQ ID NO: 526965 - RNA, 32 nt, Human
ugguccuuccugccugagcccugcacuguccc

SEQ ID NO: 526966 - RNA, 21 nt, Human
ugguccuuggggaggcugcca

SEQ ID NO: 526967 - RNA, 21 nt, Human
ugguccuuguccauucucuca

SEQ ID NO: 526968 - RNA, 32 nt, Human
ugguccuuguguugugagcuccuuguuccugc

SEQ ID NO: 526969 - RNA, 32 nt, Human
ugguccuuuuuaaacuacuaguuuuaaaaacc

SEQ ID NO: 526970 - RNA, 32 nt, Human
uggucgagauggggugucccuguguugcccag

SEQ ID NO: 526971 - RNA, 32 nt, Human
uggucgaggcuaguggagucccagggaccgcu

SEQ ID NO: 526972 - RNA, 32 nt, Human
uggucgcagcugcucgggaggcugaggcagga

SEQ ID NO: 526973 - RNA, 31 nt, Human
uggucgcauuuucccugccuaccucacagag

SEQ ID NO: 526974 - RNA, 32 nt, Human
uggucgccuaucuccuuccucugcucccuggu

SEQ ID NO: 526975 - RNA, 24 nt, Human
uggucgccuccauuagugugccac

SEQ ID NO: 526976 - RNA, 32 nt, Human
uggucgccugccccacucccuccuggaaaugu

SEQ ID NO: 526977 - RNA, 32 nt, Human
uggucgccuggaggaagccggaggccugcgug

SEQ ID NO: 526978 - RNA, 32 nt, Human
uggucgccuugcuugccagcaguugcucccuu

SEQ ID NO: 526979 - RNA, 32 nt, Human
uggucgcucucagaccccacuguccaccgggg

SEQ ID NO: 526980 - RNA, 32 nt, Human
uggucgcugcucgcgcggucuccugggugacg

SEQ ID NO: 526981 - RNA, 32 nt, Human
uggucgcuucuucuccuuggauuuguuaagga

SEQ ID NO: 526982 - RNA, 32 nt, Human
uggucggaagugagugaaggagccaggucgcc

SEQ ID NO: 526983 - RNA, 32 nt, Human
uggucggaggcagagguguuuccagugaucgg

SEQ ID NO: 526984 - RNA, 32 nt, Human
uggucgggccggccuuccccagcccucugggg

SEQ ID NO: 526985 - RNA, 32 nt, Human
uggucggggagcugggguacagguuuggggag

SEQ ID NO: 526986 - RNA, 32 nt, Human
uggucgggggccugggcuggugcuucaugguc

SEQ ID NO: 526987 - RNA, 32 nt, Human
uggucggggugagaacccaagcguuggaacug

SEQ ID NO: 526988 - RNA, 32 nt, Human
uggucgguaguaaccagggccucuccaagccc

SEQ ID NO: 526989 - RNA, 32 nt, Human
uggucguccucacugcucacuauaugcuaauu

SEQ ID NO: 526990 - RNA, 32 nt, Human
uggucgucuaucucccuguuguucuucccauc

SEQ ID NO: 526991 - RNA, 32 nt, Human
uggucgugugugugcggaguccacggaagccu

SEQ ID NO: 526992 - RNA, 32 nt, Human
uggucguucuggcaaaggcgcacacugacuuu

SEQ ID NO: 526993 - RNA, 32 nt, Human
uggucuaaaaauaaucccagcacuuugggagg

SEQ ID NO: 526994 - RNA, 32 nt, Human
uggucuacacacacagaggaugcuggauacug

SEQ ID NO: 526995 - RNA, 32 nt, Human
uggucuacauggugaaaccccaucucaacuaa

SEQ ID NO: 526996 - RNA, 32 nt, Human
uggucuacccuuuucucacuguagcugcuggc

SEQ ID NO: 526997 - RNA, 32 nt, Human
uggucuacuuuuuccuguaggauuuuauugua

SEQ ID NO: 526998 - RNA, 32 nt, Human
uggucuagaggcugcuggcccaagagccaggc

SEQ ID NO: 526999 - RNA, 32 nt, Human
uggucuagagguggagcacagugaaagaauuc

SEQ ID NO: 527000 - RNA, 31 nt, Human
uggucuaggauagccuuacucacuugccugg

SEQ ID NO: 527001 - RNA, 32 nt, Human
uggucuagggacguucucucuccaguccucag

SEQ ID NO: 527002 - RNA, 32 nt, Human
uggucuauucagaaucaaaccuuuuuauauuu

SEQ ID NO: 527003 - RNA, 23 nt, Human
uggucucaaaaaccuuugaggaa

SEQ ID NO: 527004 - RNA, 22 nt, Human
uggucucaaccuccugggcuca

SEQ ID NO: 527005 - RNA, 32 nt, Human
uggucucaacuacucaggaggcugaggcugga

SEQ ID NO: 527006 - RNA, 25 nt, Human
uggucucaagugauccgcccgccuc

SEQ ID NO: 527007 - RNA, 32 nt, Human
uggucucaccucggcugcagaaacccacccug

SEQ ID NO: 527008 - RNA, 32 nt, Human
uggucucacugcaaccucuaccucccagguuc

SEQ ID NO: 527009 - RNA, 32 nt, Human
uggucucagagaacacaguagauguguaguca

SEQ ID NO: 527010 - RNA, 32 nt, Human
uggucucagauacuugggaggcugagguggga

SEQ ID NO: 527011 - RNA, 32 nt, Human
uggucucagcacuuugggaggcugaagugggu

SEQ ID NO: 527012 - RNA, 32 nt, Human
uggucucagcuacucaggaggcugagguggga

SEQ ID NO: 527013 - RNA, 32 nt, Human
uggucucagcuacucagggggcugaggcugga

SEQ ID NO: 527014 - RNA, 32 nt, Human
uggucucagcuacucgggaggcugagguggga

SEQ ID NO: 527015 - RNA, 32 nt, Human
uggucucagcuacuugggaggcugaggcagga

SEQ ID NO: 527016 - RNA, 32 nt, Human
uggucucagcuacuugggaggcugagguggga

SEQ ID NO: 527017 - RNA, 32 nt, Human
uggucucagcuacuugggaggcugggguggga

SEQ ID NO: 527018 - RNA, 32 nt, Human
uggucucagcuauucaggaggccaaggcagga

SEQ ID NO: 527019 - RNA, 32 nt, Human
uggucucagcuauucaggaggcugaggcagga

SEQ ID NO: 527020 - RNA, 32 nt, Human
uggucucagguguggacucggcaagaaccagc

SEQ ID NO: 527021 - RNA, 32 nt, Human
uggucucagugacugaaaacucaacccaaacu

SEQ ID NO: 527022 - RNA, 32 nt, Human
uggucucauccauuccuuugcuuuuucauacc

SEQ ID NO: 527023 - RNA, 32 nt, Human
uggucucauccucugcuuccuuugccuuuacc

SEQ ID NO: 527024 - RNA, 32 nt, Human
uggucucauguugaccuuagaguuugggauuc

SEQ ID NO: 527025 - RNA, 22 nt, Human
uggucuccaacuccugagcuca

SEQ ID NO: 527026 - RNA, 22 nt, Human
uggucuccaacuccuggacuca

SEQ ID NO: 527027 - RNA, 22 nt, Human
uggucuccaacuccugggcuca

SEQ ID NO: 527028 - RNA, 32 nt, Human
uggucuccauucucuucagcucccuacauggg

SEQ ID NO: 527029 - RNA, 22 nt, Human
uggucuccccacagaccgcagg

SEQ ID NO: 527030 - RNA, 32 nt, Human
uggucucccccgcccggggacccccugugccu

SEQ ID NO: 527031 - RNA, 32 nt, Human
uggucucccgguuauuuuaauagagcugaacc

SEQ ID NO: 527032 - RNA, 32 nt, Human
uggucucccugggggcuccccaguggcucugc

SEQ ID NO: 527033 - RNA, 32 nt, Human
uggucuccgucccucuaucucuggcuccugca

SEQ ID NO: 527034 - RNA, 32 nt, Human
uggucuccuagagaugagugcuugggauuucu

SEQ ID NO: 527035 - RNA, 32 nt, Human
uggucuccuuucugguccuuuuuaggcaccug

SEQ ID NO: 527036 - RNA, 32 nt, Human
uggucucgaacuccugaucucaugauccaccc

SEQ ID NO: 527037 - RNA, 32 nt, Human
uggucucgaucuccugaccucuugaucugccc

SEQ ID NO: 527038 - RNA, 32 nt, Human
uggucucggucccaggguggucccagcuggug

SEQ ID NO: 527039 - RNA, 32 nt, Human
uggucucuauugaccaauguauuucaaacuuu

SEQ ID NO: 527040 - RNA, 32 nt, Human
uggucucucuccagauaccccacgaggaagca

SEQ ID NO: 527041 - RNA, 32 nt, Human
uggucucucuuacaccagcuccugccucacaa

SEQ ID NO: 527042 - RNA, 32 nt, Human
uggucucugaagacugggcaggccuguacuuu

SEQ ID NO: 527043 - RNA, 32 nt, Human
uggucucugaaucagugugcagcugggguccc

SEQ ID NO: 527044 - RNA, 32 nt, Human
uggucucugaauugaaaugcugucuacugaaa

SEQ ID NO: 527045 - RNA, 32 nt, Human
uggucucugcauggaccccagggcugugggga

SEQ ID NO: 527046 - RNA, 32 nt, Human
uggucucugccugacccagccaccccacugug

SEQ ID NO: 527047 - RNA, 32 nt, Human
uggucucugccugggcucaaccucugugauuu

SEQ ID NO: 527048 - RNA, 32 nt, Human
uggucucugcuccagauaacucucuuuccuug

SEQ ID NO: 527049 - RNA, 32 nt, Human
uggucucuggcaagccucccacccccaaacga

SEQ ID NO: 527050 - RNA, 32 nt, Human
uggucucuggcagugggauccuggagaggaga

SEQ ID NO: 527051 - RNA, 32 nt, Human
uggucucuguagcugagagagacagagcugga

SEQ ID NO: 527052 - RNA, 32 nt, Human
uggucucuguccuguacccucuaccuccuucc

SEQ ID NO: 527053 - RNA, 32 nt, Human
uggucucugucuucaaagccagaaggaggacg

SEQ ID NO: 527054 - RNA, 32 nt, Human
uggucugaauguggacccucucuccccgaccu

SEQ ID NO: 527055 - RNA, 32 nt, Human
uggucugacugcacugucuccaucuuaugcaa

SEQ ID NO: 527056 - RNA, 32 nt, Human
uggucugagccccagcccuacagaggggccug

SEQ ID NO: 527057 - RNA, 32 nt, Human
uggucugcacacaccugcacacaccugcacac

SEQ ID NO: 527058 - RNA, 23 nt, Human
uggucugcaggcagggcugacuc

SEQ ID NO: 527059 - RNA, 32 nt, Human
uggucugcccugcagcuguugggcugggagcu

SEQ ID NO: 527060 - RNA, 32 nt, Human
uggucugcuccugcaccaaagccauaugggug

SEQ ID NO: 527061 - RNA, 32 nt, Human
uggucuggaagaaacaucuaucaagcaacaca

SEQ ID NO: 527062 - RNA, 32 nt, Human
uggucuggacaccaccuggccuggugggagag

SEQ ID NO: 527063 - RNA, 32 nt, Human
uggucuggaucucuugaccucaggugauccau

SEQ ID NO: 527064 - RNA, 23 nt, Human
uggucuggccacugucccaggcu

SEQ ID NO: 527065 - RNA, 32 nt, Human
uggucuggccuagguuaagugugcaagauaac

SEQ ID NO: 527066 - RNA, 32 nt, Human
uggucugggaggaucacaggaugucaaggccu

SEQ ID NO: 527067 - RNA, 32 nt, Human
uggucugggcugucuaccuuccucacuguauc

SEQ ID NO: 527068 - RNA, 32 nt, Human
uggucuggggcugagggcaaggacugcacuag

SEQ ID NO: 527069 - RNA, 32 nt, Human
uggucugggggaggggacacccccggaggcug

SEQ ID NO: 527070 - RNA, 26 nt, Human
uggucuggucucuuguuugccaggcu

SEQ ID NO: 527071 - RNA, 32 nt, Human
uggucugguguuggcgugugggagacaugugu

SEQ ID NO: 527072 - RNA, 32 nt, Human
uggucuguauggcuccgcccugggcaggagga

SEQ ID NO: 527073 - RNA, 32 nt, Human
uggucuguccucacaugugcacugguaacaga

SEQ ID NO: 527074 - RNA, 32 nt, Human
uggucugucgccaggcuggagugcaguggcgc

SEQ ID NO: 527075 - RNA, 32 nt, Human
uggucugucgcccaggcuggagugcaguagca

SEQ ID NO: 527076 - RNA, 32 nt, Human
uggucugucugccccgccugucuggcugucag

SEQ ID NO: 527077 - RNA, 32 nt, Human
uggucugucuggagcagcugcagccgcagcug

SEQ ID NO: 527078 - RNA, 18 nt, Human
uggucugugcugcuguua

SEQ ID NO: 527079 - RNA, 20 nt, Human
uggucugugcuucuuccaua

SEQ ID NO: 527080 - RNA, 32 nt, Human
uggucugugcuugguuuaacagcuccaacaau

SEQ ID NO: 527081 - RNA, 32 nt, Human
uggucugugucgcuguccccagucccaccgca

SEQ ID NO: 527082 - RNA, 32 nt, Human
uggucuguuacccaggcuggagugcaguggca

SEQ ID NO: 527083 - RNA, 32 nt, Human
uggucuguucuaagccacaaccccugucucag

SEQ ID NO: 527084 - RNA, 32 nt, Human
uggucuguugcccaggcuggaaugcaguggug

SEQ ID NO: 527085 - RNA, 32 nt, Human
uggucuguugcccaggcuggagugcaguggug

SEQ ID NO: 527086 - RNA, 32 nt, Human
uggucuuagugguggaucaucagguagacaag

SEQ ID NO: 527087 - RNA, 32 nt, Human
uggucuucacauauacucucaaagcuagucug

SEQ ID NO: 527088 - RNA, 32 nt, Human
uggucuucauaagguuugaaaaccuaacaucu

SEQ ID NO: 527089 - RNA, 32 nt, Human
uggucuucaucaccugaggccaccaggcucaa

SEQ ID NO: 527090 - RNA, 32 nt, Human
uggucuucauuucuccuuagucuccuccaggc

SEQ ID NO: 527091 - RNA, 32 nt, Human
uggucuucuacccugucuucuauguuuguauc

SEQ ID NO: 527092 - RNA, 20 nt, Human
uggucuucuccagacuggug

SEQ ID NO: 527093 - RNA, 22 nt, Human
uggucuugaacaccugaccuca

SEQ ID NO: 527094 - RNA, 32 nt, Human
uggucuugaacuccuagguugaagggaucuuc

SEQ ID NO: 527095 - RNA, 32 nt, Human
uggucuugaacuccugaccuugugauccgcuc

SEQ ID NO: 527096 - RNA, 18 nt, Human
uggucuugacuugucaua

SEQ ID NO: 527097 - RNA, 32 nt, Human
uggucuugaucuccuaaccucuugaucugccc

SEQ ID NO: 527098 - RNA, 32 nt, Human
uggucuugaucuccugaccucaugauccaccc

SEQ ID NO: 527099 - RNA, 32 nt, Human
uggucuugcacccugcucacugcuggcaucac

SEQ ID NO: 527100 - RNA, 32 nt, Human
uggucuugcccagcugggcugccucagguguc

SEQ ID NO: 527101 - RNA, 32 nt, Human
uggucuugccccaucacugcgccacugcuccg

SEQ ID NO: 527102 - RNA, 32 nt, Human
uggucuugcugaccagccuggccggcuggcgg

SEQ ID NO: 527103 - RNA, 32 nt, Human
uggucuugcuucaguguugauggcuacugacu

SEQ ID NO: 527104 - RNA, 32 nt, Human
uggucuuggauugucugaccucaguagcuauu

SEQ ID NO: 527105 - RNA, 32 nt, Human
uggucuugggccaguucucccacgacggcuca

SEQ ID NO: 527106 - RNA, 32 nt, Human
uggucuugggcuguguucagccacuuugccuu

SEQ ID NO: 527107 - RNA, 18 nt, Human
uggucuugguccugaaua

SEQ ID NO: 527108 - RNA, 19 nt, Human
uggucuuguauuccuuccu

SEQ ID NO: 527109 - RNA, 20 nt, Human
uggucuuucugggccuuacu

SEQ ID NO: 527110 - RNA, 32 nt, Human
uggucuuugaggauguagaugugaacuucacc

SEQ ID NO: 527111 - RNA, 20 nt, Human
uggucuuugcugugccuucu

SEQ ID NO: 527112 - RNA, 32 nt, Human
uggucuuugcuuuugcagggccuucugugcag

SEQ ID NO: 527113 - RNA, 20 nt, Human
uggucuuuguaucuuccaua

SEQ ID NO: 527114 - RNA, 32 nt, Human
uggucuuuucccaaggcucuuccagaccugca

SEQ ID NO: 527115 - RNA, 32 nt, Human
uggucuuuuguaguggagaaccuccucccugg

SEQ ID NO: 527116 - RNA, 32 nt, Human
uggugaaaaaucaaggggacucaucucucgcc

SEQ ID NO: 527117 - RNA, 32 nt, Human
uggugaaaaggacuccgggggccaggugcugu

SEQ ID NO: 527118 - RNA, 32 nt, Human
uggugaaaaggagccaaauucaccugcagggc

SEQ ID NO: 527119 - RNA, 32 nt, Human
uggugaaacaccgucuccacuaaaaauagaaa

SEQ ID NO: 527120 - RNA, 32 nt, Human
uggugaaacauggugaaaccccgucucuacua

SEQ ID NO: 527121 - RNA, 32 nt, Human
uggugaaacccaugggcaggguggguggaggg

SEQ ID NO: 527122 - RNA, 32 nt, Human
uggugaaaccccaucucuaccaaaaauacaaa

SEQ ID NO: 527123 - RNA, 32 nt, Human
uggugaaaccccaucucuaccaaaaauacagg

SEQ ID NO: 527124 - RNA, 32 nt, Human
uggugaaacuagccuggaauaaugccaccaga

SEQ ID NO: 527125 - RNA, 32 nt, Human
uggugaaacuccgucucuacuaaaaauagaaa

SEQ ID NO: 527126 - RNA, 32 nt, Human
uggugaaacugacccaaauauguaauaaauac

SEQ ID NO: 527127 - RNA, 19 nt, Human
uggugaaagacuuagcgga

SEQ ID NO: 527128 - RNA, 32 nt, Human
uggugaaaugccgucucuacuaaaaauacaaa

SEQ ID NO: 527129 - RNA, 32 nt, Human
uggugaacuucuguggccaccaccuccugcuc

SEQ ID NO: 527130 - RNA, 21 nt, Human
uggugaagacccagggaaccc

SEQ ID NO: 527131 - RNA, 32 nt, Human
uggugaagacccagggaacccaggagggcccu

SEQ ID NO: 527132 - RNA, 32 nt, Human
uggugaagacucaugaucuuucucccaaacac

SEQ ID NO: 527133 - RNA, 32 nt, Human
uggugaagaggaagagcuccgagggccaggag

SEQ ID NO: 527134 - RNA, 32 nt, Human
uggugaagccaaagcacaggaaugcuuuaaaa

SEQ ID NO: 527135 - RNA, 32 nt, Human
uggugaagccaagagugaacugauguuucauu

SEQ ID NO: 527136 - RNA, 32 nt, Human
uggugaagcuggaaacacugagcugaguguug

SEQ ID NO: 527137 - RNA, 32 nt, Human
uggugaagcugggcccucccacccugagccuu

SEQ ID NO: 527138 - RNA, 32 nt, Human
uggugaaggacaccuccauccauuccacgcag

SEQ ID NO: 527139 - RNA, 32 nt, Human
uggugaaggagucucgcugagcucgaggaggu

SEQ ID NO: 527140 - RNA, 32 nt, Human
uggugaagggguaguggagggagccggcaugg

SEQ ID NO: 527141 - RNA, 32 nt, Human
uggugaagugaauacagaucugugaagaacaa

SEQ ID NO: 527142 - RNA, 31 nt, Human
uggugaagugagaaaaacagaaugcagcuuu

SEQ ID NO: 527143 - RNA, 32 nt, Human
uggugaagugauaucucauuauaauuuuaauu

SEQ ID NO: 527144 - RNA, 32 nt, Human
uggugaauggcugccucacauugcuccaguuu

SEQ ID NO: 527145 - RNA, 20 nt, Human
uggugacaaauucuagcaaa

SEQ ID NO: 527146 - RNA, 31 nt, Human
uggugacacagcuagggucuuccuagcagcu

SEQ ID NO: 527147 - RNA, 32 nt, Human
uggugacacucagaggggucugaacagacuug

SEQ ID NO: 527148 - RNA, 32 nt, Human
uggugacagccagauucucuacucuuauguuu

SEQ ID NO: 527149 - RNA, 32 nt, Human
uggugacaggcagcaggguggcgacauggaga

SEQ ID NO: 527150 - RNA, 23 nt, Human
uggugacaguggcgugcucaggg

SEQ ID NO: 527151 - RNA, 32 nt, Human
uggugacauauauguggcagagaugguagugc

SEQ ID NO: 527152 - RNA, 32 nt, Human
uggugaccaaccacauaacucgagacagggac

SEQ ID NO: 527153 - RNA, 24 nt, Human
uggugaccagggucuccaccaggg

SEQ ID NO: 527154 - RNA, 20 nt, Human
uggugaccaggugggcaggg

SEQ ID NO: 527155 - RNA, 32 nt, Human
uggugacccccuugauucccaccguacaaccc

SEQ ID NO: 527156 - RNA, 32 nt, Human
uggugacccuugccucuggggaaggguuagca

SEQ ID NO: 527157 - RNA, 23 nt, Human
uggugaccuccauuggugcucca

SEQ ID NO: 527158 - RNA, 32 nt, Human
uggugaccuguuggcuccacucuugucacuca

SEQ ID NO: 527159 - RNA, 21 nt, Human
uggugacucaugccuguaauc

SEQ ID NO: 527160 - RNA, 32 nt, Human
uggugacuccagccucuuucuccuggagguca

SEQ ID NO: 527161 - RNA, 32 nt, Human
uggugacuccgacaucugaaacguuuuaaguu

SEQ ID NO: 527162 - RNA, 32 nt, Human
uggugacucucaucuugcagcaggccacacug

SEQ ID NO: 527163 - RNA, 32 nt, Human
uggugacugaaacauucacacagggcucuugg

SEQ ID NO: 527164 - RNA, 32 nt, Human
uggugacugagcggagcccggugacaggaugg

SEQ ID NO: 527165 - RNA, 32 nt, Human
uggugacugagcggagcccggugacaggaugu

SEQ ID NO: 527166 - RNA, 20 nt, Human
uggugacugcgugaguggag

SEQ ID NO: 527167 - RNA, 32 nt, Human
uggugacuggagagagagcugggaggggcaca

SEQ ID NO: 527168 - RNA, 32 nt, Human
uggugacuggagagguggauuguagcuacaug

SEQ ID NO: 527169 - RNA, 32 nt, Human
uggugacuggauagcaguuuuaaguggcguuc

SEQ ID NO: 527170 - RNA, 32 nt, Human
uggugacugggucuugggaucccaggccacgc

SEQ ID NO: 527171 - RNA, 32 nt, Human
uggugacuuccucgccucucccaccccaugca

SEQ ID NO: 527172 - RNA, 32 nt, Human
uggugacuugucagugucugugucugugugug

SEQ ID NO: 527173 - RNA, 32 nt, Human
uggugacuuucugcagugaaugcaucacccuu

SEQ ID NO: 527174 - RNA, 32 nt, Human
uggugagaagugaacauuuauuaaacagaagu

SEQ ID NO: 527175 - RNA, 32 nt, Human
uggugagagguggacccaggaggaguggcagg

SEQ ID NO: 527176 - RNA, 32 nt, Human
uggugagaguccaacagacacaauuuauacug

SEQ ID NO: 527177 - RNA, 32 nt, Human
uggugagauaaauagguugaaaacaaucaucu

SEQ ID NO: 527178 - RNA, 32 nt, Human
uggugagaucagauguggccaagggaaggagc

SEQ ID NO: 527179 - RNA, 32 nt, Human
uggugagauccucuuaggacuuuuggcaauca

SEQ ID NO: 527180 - RNA, 32 nt, Human
uggugagaugacgaccuuagugcuggauaaug

SEQ ID NO: 527181 - RNA, 32 nt, Human
uggugagauuacaggcaugagccaccacaacu

SEQ ID NO: 527182 - RNA, 32 nt, Human
uggugagcacacuguccacagccuccaugaac

SEQ ID NO: 527183 - RNA, 32 nt, Human
uggugagcacugcagccucccugggcauuccc

SEQ ID NO: 527184 - RNA, 32 nt, Human
uggugagcaguggauauaugccugucaaaguc

SEQ ID NO: 527185 - RNA, 32 nt, Human
uggugagccacuggcauugggcaggcgggcca

SEQ ID NO: 527186 - RNA, 32 nt, Human
uggugagcuaaggcugaggaguggagaugacc

SEQ ID NO: 527187 - RNA, 32 nt, Human
uggugagcucacuccuuccccugaugacuggc

SEQ ID NO: 527188 - RNA, 32 nt, Human
uggugaggaagagugggguagagccaggcggc

SEQ ID NO: 527189 - RNA, 32 nt, Human
uggugaggacaggcacaaacgcaaagaaagaa

SEQ ID NO: 527190 - RNA, 21 nt, Human
uggugaggaccucaaggaccc

SEQ ID NO: 527191 - RNA, 32 nt, Human
uggugaggaggucugggcaccuccuccauggc

SEQ ID NO: 527192 - RNA, 32 nt, Human
uggugaggagugagguggcucuggccucccau

SEQ ID NO: 527193 - RNA, 32 nt, Human
uggugaggagugggagggcccagcaagcauuu

SEQ ID NO: 527194 - RNA, 32 nt, Human
uggugaggcuccggaucucaggagcagcccug

SEQ ID NO: 527195 - RNA, 32 nt, Human
uggugaggcugucaguguauggggcagcuucc

SEQ ID NO: 527196 - RNA, 32 nt, Human
uggugagggaaaagguauaauuugggauucca

SEQ ID NO: 527197 - RNA, 32 nt, Human
uggugagggccaggggacaggucggggcagua

SEQ ID NO: 527198 - RNA, 32 nt, Human
uggugagggcugggcuuuugcuguccucuucu

SEQ ID NO: 527199 - RNA, 31 nt, Human
uggugaguagauccuguuuccuuugggaaaa

SEQ ID NO: 527200 - RNA, 32 nt, Human
uggugagucgggacucagcugaggacacaucc

SEQ ID NO: 527201 - RNA, 32 nt, Human
uggugagucggugaccuggccugugaggagca

SEQ ID NO: 527202 - RNA, 32 nt, Human
uggugagugccuguaaucacagcuacuuggga

SEQ ID NO: 527203 - RNA, 32 nt, Human
uggugagugccuguaaucccagcuacucggga

SEQ ID NO: 527204 - RNA, 32 nt, Human
uggugagugccuguaaucccagcuacuuggga

SEQ ID NO: 527205 - RNA, 32 nt, Human
uggugagugccuguagucccagcuacucagga

SEQ ID NO: 527206 - RNA, 32 nt, Human
uggugaguggguacagacuaggaggacguguc

SEQ ID NO: 527207 - RNA, 32 nt, Human
uggugaguuucacaccugaagccagccaggug

SEQ ID NO: 527208 - RNA, 32 nt, Human
uggugauaaagugcgggucaaagccucuguca

SEQ ID NO: 527209 - RNA, 32 nt, Human
uggugauaauggucaccugccaugcagccuuu

SEQ ID NO: 527210 - RNA, 32 nt, Human
uggugauacagauagcaugugaggcaggcaug

SEQ ID NO: 527211 - RNA, 32 nt, Human
uggugauacuguacuccagccugagcaacaga

SEQ ID NO: 527212 - RNA, 32 nt, Human
uggugauauaaauauuuccaaaugcauuugua

SEQ ID NO: 527213 - RNA, 32 nt, Human
uggugaucaucuccucaccccaucucccaccu

SEQ ID NO: 527214 - RNA, 32 nt, Human
uggugaucuaugaucagugaucuuugauguug

SEQ ID NO: 527215 - RNA, 30 nt, Human
uggugaugacggugaaaacugaggcugcua

SEQ ID NO: 527216 - RNA, 32 nt, Human
uggugaugaggaagcauuuagcugaauaaguu

SEQ ID NO: 527217 - RNA, 32 nt, Human
uggugaugaucugcugauaugcauuuauaaag

SEQ ID NO: 527218 - RNA, 32 nt, Human
uggugauggaauagguuugugcucugauucua

SEQ ID NO: 527219 - RNA, 32 nt, Human
uggugauggccccugggcuggagcccccaugg

SEQ ID NO: 527220 - RNA, 32 nt, Human
uggugauggggaaaucagaagcuuugagaccc

SEQ ID NO: 527221 - RNA, 32 nt, Human
uggugaugggguggucugagggccaaguuaau

SEQ ID NO: 527222 - RNA, 32 nt, Human
uggugaugguuugcauccuuccuccuuugucc

SEQ ID NO: 527223 - RNA, 32 nt, Human
uggugauguaccacucccgagaauauucccau

SEQ ID NO: 527224 - RNA, 23 nt, Human
uggugaugucggcugggugcagu

SEQ ID NO: 527225 - RNA, 32 nt, Human
uggugaugucggcugggugcaguggcucaugc

SEQ ID NO: 527226 - RNA, 32 nt, Human
uggugaugucuguaaucccagcaguuugcaaa

SEQ ID NO: 527227 - RNA, 32 nt, Human
uggugauuuccagccuuuacugcuuugaagaa

SEQ ID NO: 527228 - RNA, 32 nt, Human
uggugauuugcuuucucucuuucacuugguuc

SEQ ID NO: 527229 - RNA, 24 nt, Human
uggugcaaccucagcucacugcag

SEQ ID NO: 527230 - RNA, 32 nt, Human
uggugcaaucacagcucacagcaacuucaaac

SEQ ID NO: 527231 - RNA, 32 nt, Human
uggugcaaucacagcucacugcagccucgacc

SEQ ID NO: 527232 - RNA, 32 nt, Human
uggugcaaucacagcucacugcagccuugucc

SEQ ID NO: 527233 - RNA, 32 nt, Human
uggugcaaucacaggucacugcagcccugacc

SEQ ID NO: 527234 - RNA, 32 nt, Human
uggugcaaucacugaucacugcagccuccacu

SEQ ID NO: 527235 - RNA, 32 nt, Human
uggugcaaucauagcucacugcagccuugacc

SEQ ID NO: 527236 - RNA, 32 nt, Human
uggugcaaucauagcucacugcagccuugagc

SEQ ID NO: 527237 - RNA, 32 nt, Human
uggugcaaucauagcucauugcagccuucaau

SEQ ID NO: 527238 - RNA, 32 nt, Human
uggugcaaucauggcucacugcagccucgacc

SEQ ID NO: 527239 - RNA, 32 nt, Human
uggugcaaucauggcucacugcaggcucaaag

SEQ ID NO: 527240 - RNA, 23 nt, Human
uggugcaaucucagcucacugca

SEQ ID NO: 527241 - RNA, 23 nt, Human
uggugcaaucucggcucacugca

SEQ ID NO: 527242 - RNA, 24 nt, Human
uggugcaaucucggcucacuguag

SEQ ID NO: 527243 - RNA, 32 nt, Human
uggugcaaucuugacucacugcagccucaacc

SEQ ID NO: 527244 - RNA, 24 nt, Human
uggugcaaucuuggcucacuauag

SEQ ID NO: 527245 - RNA, 23 nt, Human
uggugcaaucuuggcucacugca

SEQ ID NO: 527246 - RNA, 24 nt, Human
uggugcaaucuuggcucacugcag

SEQ ID NO: 527247 - RNA, 23 nt, Human
uggugcaaucuuggcucacugua

SEQ ID NO: 527248 - RNA, 32 nt, Human
uggugcaauuguagauggcugcagcccucgac

SEQ ID NO: 527249 - RNA, 32 nt, Human
uggugcacaccugaaaucccagcuacugaaga

SEQ ID NO: 527250 - RNA, 24 nt, Human
uggugcacaccuguaaucccagcu

SEQ ID NO: 527251 - RNA, 24 nt, Human
uggugcacaccuguaaucccaguu

SEQ ID NO: 527252 - RNA, 24 nt, Human
uggugcacaccugugaucccagcu

SEQ ID NO: 527253 - RNA, 32 nt, Human
uggugcacauccagggaagaggagugucggua

SEQ ID NO: 527254 - RNA, 32 nt, Human
uggugcaccagcugcuggaagcgcugcuuuug

SEQ ID NO: 527255 - RNA, 32 nt, Human
uggugcaccauccugaaguuacuggagguaga

SEQ ID NO: 527256 - RNA, 24 nt, Human
uggugcaccccuguaaucccagcu

SEQ ID NO: 527257 - RNA, 24 nt, Human
uggugcacgccuguaaucccagcu

SEQ ID NO: 527258 - RNA, 32 nt, Human
uggugcacgccuguaaucucagcuacuuggga

SEQ ID NO: 527259 - RNA, 24 nt, Human
uggugcacgccugugaucccagcu

SEQ ID NO: 527260 - RNA, 24 nt, Human
uggugcacgcuuguaaucccagcu

SEQ ID NO: 527261 - RNA, 32 nt, Human
uggugcacucacugugcucagcaccucaggaa

SEQ ID NO: 527262 - RNA, 24 nt, Human
uggugcacuccuguaaucccagcu

SEQ ID NO: 527263 - RNA, 32 nt, Human
uggugcagaagcagcaggaggcacuugaggag

SEQ ID NO: 527264 - RNA, 32 nt, Human
uggugcagacccagcugccuuagacagauucc

SEQ ID NO: 527265 - RNA, 32 nt, Human
uggugcagacuagguguggauuugagcucugu

SEQ ID NO: 527266 - RNA, 32 nt, Human
uggugcagagauggaggaagaagaauaugaac

SEQ ID NO: 527267 - RNA, 32 nt, Human
uggugcagaugagguuuauaucucauuuuagc

SEQ ID NO: 527268 - RNA, 32 nt, Human
uggugcagauugugggucaggcccagaagggc

SEQ ID NO: 527269 - RNA, 32 nt, Human
uggugcagccugugggcucuuaagacaggggc

SEQ ID NO: 527270 - RNA, 32 nt, Human
uggugcagcugcagacacagagcacagcucau

SEQ ID NO: 527271 - RNA, 32 nt, Human
uggugcaggccuggcaccaggaggcuugcacc

SEQ ID NO: 527272 - RNA, 21 nt, Human
uggugcaggccuguaauccca

SEQ ID NO: 527273 - RNA, 32 nt, Human
uggugcagggagcaguagcagggacagcagag

SEQ ID NO: 527274 - RNA, 32 nt, Human
uggugcagucacagcucacugcagccucgacc

SEQ ID NO: 527275 - RNA, 17 nt, Human
uggugcagucugagaca

SEQ ID NO: 527276 - RNA, 32 nt, Human
uggugcagucuuggcucacugcagccuccacc

SEQ ID NO: 527277 - RNA, 32 nt, Human
uggugcagugugaaggagggaagugacgggca

SEQ ID NO: 527278 - RNA, 32 nt, Human
uggugcaguucugagugugccucaccugcaga

SEQ ID NO: 527279 - RNA, 24 nt, Human
uggugcauaccuguaaucccagcu

SEQ ID NO: 527280 - RNA, 32 nt, Human
uggugcauaccuguaaucccagcuacucggga

SEQ ID NO: 527281 - RNA, 24 nt, Human
uggugcauaccuguaaucccaguu

SEQ ID NO: 527282 - RNA, 32 nt, Human
uggugcauauagucccagcuacucaggaggcu

SEQ ID NO: 527283 - RNA, 32 nt, Human
uggugcauccacgcacccccacccugggacuu

SEQ ID NO: 527284 - RNA, 32 nt, Human
uggugcaugccaguaauuccagcuacuuggga

SEQ ID NO: 527285 - RNA, 32 nt, Human
uggugcaugccucacaccugagccugcuuccu

SEQ ID NO: 527286 - RNA, 32 nt, Human
uggugcaugccugaaaucccagcuacuuggga

SEQ ID NO: 527287 - RNA, 32 nt, Human
uggugcaugccugcaaucccagcuacucagag

SEQ ID NO: 527288 - RNA, 24 nt, Human
uggugcaugccuguaaccccagcu

SEQ ID NO: 527289 - RNA, 32 nt, Human
uggugcaugccuguaaccccagcuacucggga

SEQ ID NO: 527290 - RNA, 22 nt, Human
uggugcaugccuguaacuccag

SEQ ID NO: 527291 - RNA, 32 nt, Human
uggugcaugccuguaacuccagauacuuggga

SEQ ID NO: 527292 - RNA, 24 nt, Human
uggugcaugccuguaagcccagcu

SEQ ID NO: 527293 - RNA, 32 nt, Human
uggugcaugccuguaauccaagauacucagga

SEQ ID NO: 527294 - RNA, 32 nt, Human
uggugcaugccuguaauccagcuacuugggag

SEQ ID NO: 527295 - RNA, 21 nt, Human
uggugcaugccuguaauccca

SEQ ID NO: 527296 - RNA, 24 nt, Human
uggugcaugccuguaaucccaacu

SEQ ID NO: 527297 - RNA, 32 nt, Human
uggugcaugccuguaaucccacuacuggggug

SEQ ID NO: 527298 - RNA, 23 nt, Human
uggugcaugccuguaaucccagc

SEQ ID NO: 527299 - RNA, 32 nt, Human
uggugcaugccuguaaucccagccacucagga

SEQ ID NO: 527300 - RNA, 24 nt, Human
uggugcaugccuguaaucccagcu

SEQ ID NO: 527301 - RNA, 32 nt, Human
uggugcaugccuguaaucccagcuacccugaa

SEQ ID NO: 527302 - RNA, 32 nt, Human
uggugcaugccuguaaucccagcuacuaggga

SEQ ID NO: 527303 - RNA, 32 nt, Human
uggugcaugccuguaaucccagcuacucagga

SEQ ID NO: 527304 - RNA, 32 nt, Human
uggugcaugccuguaaucccagcuacucggaa

SEQ ID NO: 527305 - RNA, 32 nt, Human
uggugcaugccuguaaucccagcuacucggga

SEQ ID NO: 527306 - RNA, 32 nt, Human
uggugcaugccuguaaucccagcuacucugga

SEQ ID NO: 527307 - RNA, 32 nt, Human
uggugcaugccuguaaucccagcuacuuggaa

SEQ ID NO: 527308 - RNA, 32 nt, Human
uggugcaugccuguaaucccagcuacuuggga

SEQ ID NO: 527309 - RNA, 32 nt, Human
uggugcaugccuguaaucccagcugcucagga

SEQ ID NO: 527310 - RNA, 32 nt, Human
uggugcaugccuguaaucccagcugcugggga

SEQ ID NO: 527311 - RNA, 32 nt, Human
uggugcaugccuguaaucccagcugcuuggga

SEQ ID NO: 527312 - RNA, 32 nt, Human
uggugcaugccuguaaucccagcuucuuggga

SEQ ID NO: 527313 - RNA, 24 nt, Human
uggugcaugccuguaaucccaguu

SEQ ID NO: 527314 - RNA, 32 nt, Human
uggugcaugccuguaaucccaguuacucagga

SEQ ID NO: 527315 - RNA, 32 nt, Human
uggugcaugccuguaaucccaguuacuccaga

SEQ ID NO: 527316 - RNA, 32 nt, Human
uggugcaugccuguaaucccaguuacucgaga

SEQ ID NO: 527317 - RNA, 24 nt, Human
uggugcaugccuguaaucccugcu

SEQ ID NO: 527318 - RNA, 32 nt, Human
uggugcaugccuguaaucccugcuacuuggga

SEQ ID NO: 527319 - RNA, 32 nt, Human
uggugcaugccuguaauccuagcuacucagga

SEQ ID NO: 527320 - RNA, 32 nt, Human
uggugcaugccuguaauccuagcuacucggga

SEQ ID NO: 527321 - RNA, 32 nt, Human
uggugcaugccuguaauccuagcugcuugggu

SEQ ID NO: 527322 - RNA, 24 nt, Human
uggugcaugccuguaaucucagcu

SEQ ID NO: 527323 - RNA, 32 nt, Human
uggugcaugccuguaaucucagcuacucggga

SEQ ID NO: 527324 - RNA, 32 nt, Human
uggugcaugccuguaaucucagcuacuuggga

SEQ ID NO: 527325 - RNA, 32 nt, Human
uggugcaugccuguaaucucagcugcuccgga

SEQ ID NO: 527326 - RNA, 32 nt, Human
uggugcaugccuguaauuccagcggcuuggaa

SEQ ID NO: 527327 - RNA, 32 nt, Human
uggugcaugccuguagucacagcuacuuggga

SEQ ID NO: 527328 - RNA, 32 nt, Human
uggugcaugccuguagucccagcuacucagga

SEQ ID NO: 527329 - RNA, 32 nt, Human
uggugcaugccuguagucccagcuacucggga

SEQ ID NO: 527330 - RNA, 32 nt, Human
uggugcaugccuguagucccagcuacucugga

SEQ ID NO: 527331 - RNA, 32 nt, Human
uggugcaugccuguagucccagcuacuugagu

SEQ ID NO: 527332 - RNA, 32 nt, Human
uggugcaugccuguagucccagcuacuuggga

SEQ ID NO: 527333 - RNA, 32 nt, Human
uggugcaugccuguagucccagcugcucagga

SEQ ID NO: 527334 - RNA, 32 nt, Human
uggugcaugccuguagucccagguacucagga

SEQ ID NO: 527335 - RNA, 32 nt, Human
uggugcaugccuguagucccgguuacucggga

SEQ ID NO: 527336 - RNA, 32 nt, Human
uggugcaugccuguaguccuagcuauuuggga

SEQ ID NO: 527337 - RNA, 32 nt, Human
uggugcaugccuguagucucagcuacucagga

SEQ ID NO: 527338 - RNA, 32 nt, Human
uggugcaugccuguaguuccagcuacucagga

SEQ ID NO: 527339 - RNA, 32 nt, Human
uggugcaugccuguaguuccagcuacuuggga

SEQ ID NO: 527340 - RNA, 32 nt, Human
uggugcaugccuguaguugcagcuacucaugg

SEQ ID NO: 527341 - RNA, 32 nt, Human
uggugcaugccuguaucccagcuacuugggag

SEQ ID NO: 527342 - RNA, 32 nt, Human
uggugcaugccuguauuccaggugcucaggag

SEQ ID NO: 527343 - RNA, 32 nt, Human
uggugcaugccuguauucccagcuacucagga

SEQ ID NO: 527344 - RNA, 32 nt, Human
uggugcaugccuguauucucagcuacucggga

SEQ ID NO: 527345 - RNA, 32 nt, Human
uggugcaugccugucaucccagcuacuccaga

SEQ ID NO: 527346 - RNA, 32 nt, Human
uggugcaugccugugauccuagcugcugggga

SEQ ID NO: 527347 - RNA, 32 nt, Human
uggugcaugccugugauccuggcuacuucaga

SEQ ID NO: 527348 - RNA, 24 nt, Human
uggugcaugccugugauuccagcu

SEQ ID NO: 527349 - RNA, 32 nt, Human
uggugcaugccugugauuccagcuacuuggga

SEQ ID NO: 527350 - RNA, 32 nt, Human
uggugcaugccuguggucccagcuacucagga

SEQ ID NO: 527351 - RNA, 32 nt, Human
uggugcaugccuguggucccagcuacuuggga

SEQ ID NO: 527352 - RNA, 32 nt, Human
uggugcaugccuguggucucagcuacuuggga

SEQ ID NO: 527353 - RNA, 32 nt, Human
uggugcaugccuguugucccagcuacucagga

SEQ ID NO: 527354 - RNA, 21 nt, Human
uggugcaugcugauugguucc

SEQ ID NO: 527355 - RNA, 32 nt, Human
uggugcaugggaggggagccgggccaggagua

SEQ ID NO: 527356 - RNA, 32 nt, Human
uggugcauguaauaauguugaguggcagucaa

SEQ ID NO: 527357 - RNA, 21 nt, Human
uggugcauguucuagcuccac

SEQ ID NO: 527358 - RNA, 32 nt, Human
uggugccaaugcauuccagccuggaugaugga

SEQ ID NO: 527359 - RNA, 32 nt, Human
uggugccaaugccagccagaguccugcggggg

SEQ ID NO: 527360 - RNA, 32 nt, Human
uggugccacacaccguugagguuggagugggc

SEQ ID NO: 527361 - RNA, 32 nt, Human
uggugccacagccccuggcagggacggccggc

SEQ ID NO: 527362 - RNA, 32 nt, Human
uggugccaccacugcaacuuuuguauucacag

SEQ ID NO: 527363 - RNA, 32 nt, Human
uggugccaccacugcagacuauugugguacuu

SEQ ID NO: 527364 - RNA, 32 nt, Human
uggugccacuacacuccagccuggguaaaaga

SEQ ID NO: 527365 - RNA, 32 nt, Human
uggugccacugcacuccaaccugggggacaga

SEQ ID NO: 527366 - RNA, 32 nt, Human
uggugccacugcacuccagaugaguacagaag

SEQ ID NO: 527367 - RNA, 32 nt, Human
uggugccacugcacuccagccuaggugacaga

SEQ ID NO: 527368 - RNA, 32 nt, Human
uggugccacugcacuccagccuggcgacagag

SEQ ID NO: 527369 - RNA, 32 nt, Human
uggugccacugcacuccagccugggcaacaga

SEQ ID NO: 527370 - RNA, 32 nt, Human
uggugccacugcacuccagccugggcgaaaga

SEQ ID NO: 527371 - RNA, 32 nt, Human
uggugccacugcacuccagccugggggacaga

SEQ ID NO: 527372 - RNA, 32 nt, Human
uggugccacugcacuccagccugggugacaga

SEQ ID NO: 527373 - RNA, 32 nt, Human
uggugccacugcacuccagccuggguggcaga

SEQ ID NO: 527374 - RNA, 32 nt, Human
uggugccacugcacuccagcuuaggugacaga

SEQ ID NO: 527375 - RNA, 32 nt, Human
uggugccacugcacuccaguauggaugacaua

SEQ ID NO: 527376 - RNA, 32 nt, Human
uggugccacugcacuccagucugggcaacaga

SEQ ID NO: 527377 - RNA, 32 nt, Human
uggugccacugcacucuaaccugggcgacaga

SEQ ID NO: 527378 - RNA, 32 nt, Human
uggugccacugcacuucagccugggcaacaga

SEQ ID NO: 527379 - RNA, 32 nt, Human
uggugccacugcauuccagccugggcaacaga

SEQ ID NO: 527380 - RNA, 32 nt, Human
uggugccacugcauuccagccugggugacaga

SEQ ID NO: 527381 - RNA, 32 nt, Human
uggugccacugcauuucugccuggcaacagag

SEQ ID NO: 527382 - RNA, 32 nt, Human
uggugccacugcgcuccagccugggggagggg

SEQ ID NO: 527383 - RNA, 32 nt, Human
uggugccacuggacuccagccugggagacaga

SEQ ID NO: 527384 - RNA, 32 nt, Human
uggugccacuguacuccagccugggugauagg

SEQ ID NO: 527385 - RNA, 32 nt, Human
uggugccagauaauugcauucucuccaccuga

SEQ ID NO: 527386 - RNA, 32 nt, Human
uggugccagccuggugccaucuugaaggcugg

SEQ ID NO: 527387 - RNA, 32 nt, Human
uggugccagccugucccccacugcuucuuacu

SEQ ID NO: 527388 - RNA, 32 nt, Human
uggugccagccuguuaccuguucucacugaaa

SEQ ID NO: 527389 - RNA, 32 nt, Human
uggugccagcuacuuggaaggcugagguagga

SEQ ID NO: 527390 - RNA, 32 nt, Human
uggugccagcugggcuggguguggguucugug

SEQ ID NO: 527391 - RNA, 32 nt, Human
uggugccaggccguggguucagguguggcaga

SEQ ID NO: 527392 - RNA, 31 nt, Human
uggugccagguguccauccccgugcugagau

SEQ ID NO: 527393 - RNA, 32 nt, Human
uggugccaguaugacccacuuggacucacccc

SEQ ID NO: 527394 - RNA, 32 nt, Human
uggugccagugucgccccgccuccgggguaga

SEQ ID NO: 527395 - RNA, 32 nt, Human
uggugccaucaugguucacugcagccuugacc

SEQ ID NO: 527396 - RNA, 32 nt, Human
uggugccaucauugcugucugcagccuugaac

SEQ ID NO: 527397 - RNA, 32 nt, Human
uggugccaugcuggcucacugcagccuccacc

SEQ ID NO: 527398 - RNA, 32 nt, Human
uggugccauugaacuccagucugggcuauuca

SEQ ID NO: 527399 - RNA, 32 nt, Human
uggugccauugcccuccagccugggcaagaac

SEQ ID NO: 527400 - RNA, 28 nt, Human
uggugcccaagugagucacauccaggua

SEQ ID NO: 527401 - RNA, 32 nt, Human
uggugcccacccgcauugaggguggguguccc

SEQ ID NO: 527402 - RNA, 32 nt, Human
uggugcccaccugcauugaggguggguguccc

SEQ ID NO: 527403 - RNA, 32 nt, Human
uggugcccagaagaaagagggcagcacccauu

SEQ ID NO: 527404 - RNA, 32 nt, Human
uggugcccaggccaaguagaaugagaugagac

SEQ ID NO: 527405 - RNA, 24 nt, Human
uggugcccaggcuagagugcaaug

SEQ ID NO: 527406 - RNA, 24 nt, Human
uggugcccaggcuggagugcagug

SEQ ID NO: 527407 - RNA, 32 nt, Human
uggugcccagguggaggugcaguggggguaag

SEQ ID NO: 527408 - RNA, 32 nt, Human
uggugccccaaaacuucacaaccaccuagaca

SEQ ID NO: 527409 - RNA, 32 nt, Human
uggugccccaggagagcgagaggcgccuggga

SEQ ID NO: 527410 - RNA, 32 nt, Human
uggugccccaggaggagcucagccuccugccc

SEQ ID NO: 527411 - RNA, 26 nt, Human
uggugccccccaaugccaggcuucac

SEQ ID NO: 527412 - RNA, 32 nt, Human
uggugccccuccacucuucucuuccucucuuu

SEQ ID NO: 527413 - RNA, 32 nt, Human
uggugccccugcccuccgccccaccacagcac

SEQ ID NO: 527414 - RNA, 32 nt, Human
uggugccccuggcuggccgaggagacuggcuc

SEQ ID NO: 527415 - RNA, 32 nt, Human
uggugcccgguggaggaugacacacacgugcc

SEQ ID NO: 527416 - RNA, 32 nt, Human
uggugcccgucuuccuccuaaggggccaggcc

SEQ ID NO: 527417 - RNA, 32 nt, Human
uggugcccuccugccacccaagcugcugcugg

SEQ ID NO: 527418 - RNA, 32 nt, Human
uggugcccucgagggccagacagugcagaggg

SEQ ID NO: 527419 - RNA, 32 nt, Human
uggugcccugaugcugugccuugucacccauu

SEQ ID NO: 527420 - RNA, 32 nt, Human
uggugcccugcaucccagcugcuccagccauu

SEQ ID NO: 527421 - RNA, 32 nt, Human
uggugcccuguuaaccccuuaaagcugugguu

SEQ ID NO: 527422 - RNA, 32 nt, Human
uggugccgacuuccuguuguuugaggccgggu

SEQ ID NO: 527423 - RNA, 20 nt, Human
uggugccgccuguaguccca

SEQ ID NO: 527424 - RNA, 23 nt, Human
uggugccgccuguagucccagcu

SEQ ID NO: 527425 - RNA, 32 nt, Human
uggugccggcagcugccagcgccugcccucug

SEQ ID NO: 527426 - RNA, 32 nt, Human
uggugccgucaugacuuacugcagccuugaac

SEQ ID NO: 527427 - RNA, 32 nt, Human
uggugccguugcacuccagccgggcaacaagg

SEQ ID NO: 527428 - RNA, 32 nt, Human
uggugccuauaucugagagaccugugugaacu

SEQ ID NO: 527429 - RNA, 32 nt, Human
uggugccucaguuuacccaucuguaaaauggg

SEQ ID NO: 527430 - RNA, 32 nt, Human
uggugccuccacucagcucaauuccaguuuuc

SEQ ID NO: 527431 - RNA, 32 nt, Human
uggugccuccagacaugugcacaugaguccau

SEQ ID NO: 527432 - RNA, 32 nt, Human
uggugccuccaggaccgcugcgggugguaacc

SEQ ID NO: 527433 - RNA, 30 nt, Human
uggugccucucguccaugcuccugggcccc

SEQ ID NO: 527434 - RNA, 32 nt, Human
uggugccucucguccaugcuccugggccccag

SEQ ID NO: 527435 - RNA, 32 nt, Human
uggugccucucuccugccgucaucacuauggc

SEQ ID NO: 527436 - RNA, 32 nt, Human
uggugccugagaggcaggcauagaggcuucuc

SEQ ID NO: 527437 - RNA, 32 nt, Human
uggugccugccagcugucuccacuguggaguu

SEQ ID NO: 527438 - RNA, 32 nt, Human
uggugccugccucccacauuugcccuuggucu

SEQ ID NO: 527439 - RNA, 23 nt, Human
uggugccugccuguaauccagcu

SEQ ID NO: 527440 - RNA, 32 nt, Human
uggugccugccuguaauccagcuacucaggag

SEQ ID NO: 527441 - RNA, 21 nt, Human
uggugccugccuguaguccca

SEQ ID NO: 527442 - RNA, 32 nt, Human
uggugccugcuguccgugucagcuuuuaucau

SEQ ID NO: 527443 - RNA, 32 nt, Human
uggugccugcuuguaauuccagcuacuuggga

SEQ ID NO: 527444 - RNA, 32 nt, Human
uggugccuggcucaauguaaguucucaauaug

SEQ ID NO: 527445 - RNA, 32 nt, Human
uggugccuguaaucccagcaguuugggaggcu

SEQ ID NO: 527446 - RNA, 32 nt, Human
uggugccuguaaucccagcuacucgggaggcu

SEQ ID NO: 527447 - RNA, 32 nt, Human
uggugccuguagucccagcuacucaggaggcu

SEQ ID NO: 527448 - RNA, 32 nt, Human
uggugccuguagucccagcuaucugggaggcu

SEQ ID NO: 527449 - RNA, 32 nt, Human
uggugccuuagugacccacaucugcaguggga

SEQ ID NO: 527450 - RNA, 32 nt, Human
uggugccuuccaccccuccaacuaugcccucc

SEQ ID NO: 527451 - RNA, 25 nt, Human
uggugccuucucaaggcaguguucc

SEQ ID NO: 527452 - RNA, 32 nt, Human
uggugccuugggaaacagucugacuugaaccc

SEQ ID NO: 527453 - RNA, 32 nt, Human
uggugccuugggccccuuagccccagcgccag

SEQ ID NO: 527454 - RNA, 26 nt, Human
uggugccuuuugcagccagcgcccac

SEQ ID NO: 527455 - RNA, 32 nt, Human
uggugcgacccaacuucauuuguuuacuugaa

SEQ ID NO: 527456 - RNA, 23 nt, Human
uggugcgaccucggcucacugca

SEQ ID NO: 527457 - RNA, 23 nt, Human
uggugcgaccucggcuuacugca

SEQ ID NO: 527458 - RNA, 23 nt, Human
uggugcgaccuuggcucacugca

SEQ ID NO: 527459 - RNA, 32 nt, Human
uggugcgagccuguaauuccagcuacuuggag

SEQ ID NO: 527460 - RNA, 32 nt, Human
uggugcgaggggcaucugggcguuugacaggu

SEQ ID NO: 527461 - RNA, 32 nt, Human
uggugcgaucauagcccacugcagccuccaac

SEQ ID NO: 527462 - RNA, 32 nt, Human
uggugcgaucauggcucacugcagccucgaac

SEQ ID NO: 527463 - RNA, 32 nt, Human
uggugcgaucauggcucacugcagccuugaac

SEQ ID NO: 527464 - RNA, 23 nt, Human
uggugcgaucucagcucaccgca

SEQ ID NO: 527465 - RNA, 23 nt, Human
uggugcgaucucagcucacugca

SEQ ID NO: 527466 - RNA, 24 nt, Human
uggugcgaucucagcucacugcag

SEQ ID NO: 527467 - RNA, 23 nt, Human
uggugcgaucucagcucccugca

SEQ ID NO: 527468 - RNA, 23 nt, Human
uggugcgaucucgacucacugca

SEQ ID NO: 527469 - RNA, 23 nt, Human
uggugcgaucucggcucacagca

SEQ ID NO: 527470 - RNA, 23 nt, Human
uggugcgaucucggcucacugca

SEQ ID NO: 527471 - RNA, 23 nt, Human
uggugcgaucucggcucucugca

SEQ ID NO: 527472 - RNA, 23 nt, Human
uggugcgaucuuagcucacugca

SEQ ID NO: 527473 - RNA, 23 nt, Human
uggugcgaucuugacucacagca

SEQ ID NO: 527474 - RNA, 23 nt, Human
uggugcgaucuugacucacugca

SEQ ID NO: 527475 - RNA, 23 nt, Human
uggugcgaucuuggcucacugca

SEQ ID NO: 527476 - RNA, 32 nt, Human
uggugcgggagcuacggggcccagggauugug

SEQ ID NO: 527477 - RNA, 32 nt, Human
uggugcgggagggaagaccucucacuuagggc

SEQ ID NO: 527478 - RNA, 32 nt, Human
uggugcggggcccugggcuggggcugucccac

SEQ ID NO: 527479 - RNA, 32 nt, Human
uggugcggucacagcucacugccuccugggcu

SEQ ID NO: 527480 - RNA, 32 nt, Human
uggugcgugccuguaaucccaacuacuuggga

SEQ ID NO: 527481 - RNA, 32 nt, Human
uggugcgugccuguaaucccagcuacucagga

SEQ ID NO: 527482 - RNA, 32 nt, Human
uggugcgugccuguaaucccagcuacucggga

SEQ ID NO: 527483 - RNA, 32 nt, Human
uggugcgugccuguaaucccagcuacucgggg

SEQ ID NO: 527484 - RNA, 32 nt, Human
uggugcgugccuguagucccagcuacucaggg

SEQ ID NO: 527485 - RNA, 32 nt, Human
uggugcgugccuguagucccagcuacucggga

SEQ ID NO: 527486 - RNA, 32 nt, Human
uggugcgugccuguagucccagcuacuuagga

SEQ ID NO: 527487 - RNA, 32 nt, Human
uggugcgugccuguagucccagcuacuuggga

SEQ ID NO: 527488 - RNA, 32 nt, Human
uggugcgugccuguagucucagcuacucagga

SEQ ID NO: 527489 - RNA, 32 nt, Human
uggugcgugccuguagugccagcuacucagga

SEQ ID NO: 527490 - RNA, 32 nt, Human
uggugcgugccuguaguuccagcuaccuggga

SEQ ID NO: 527491 - RNA, 32 nt, Human
uggugcgugccuguaguuccagcuacuuggga

SEQ ID NO: 527492 - RNA, 32 nt, Human
uggugcguggagguggagccugcggcuggagu

SEQ ID NO: 527493 - RNA, 32 nt, Human
uggugcuaacaucccaugccgcucccuccuca

SEQ ID NO: 527494 - RNA, 32 nt, Human
uggugcuauugugaauggaaagguucuaccca

SEQ ID NO: 527495 - RNA, 32 nt, Human
uggugcucaagucacucagaaugagaguccug

SEQ ID NO: 527496 - RNA, 32 nt, Human
uggugcucaccuccucucacugcuagaauauu

SEQ ID NO: 527497 - RNA, 32 nt, Human
uggugcucacugggaccccauaugucugcgua

SEQ ID NO: 527498 - RNA, 32 nt, Human
uggugcucaggggaccacagcugcaaugacag

SEQ ID NO: 527499 - RNA, 32 nt, Human
uggugcuccuagaggguggcccagaggagcug

SEQ ID NO: 527500 - RNA, 32 nt, Human
uggugcucgccuguaaucccagcuacuuggga

SEQ ID NO: 527501 - RNA, 32 nt, Human
uggugcucuaauagccuguugguuugaaugau

SEQ ID NO: 527502 - RNA, 32 nt, Human
uggugcucucuucuccccacugugcccguccg

SEQ ID NO: 527503 - RNA, 32 nt, Human
uggugcucuggccccucucguggagcuacugc

SEQ ID NO: 527504 - RNA, 32 nt, Human
uggugcucugucucccugggugacacccaccc

SEQ ID NO: 527505 - RNA, 32 nt, Human
uggugcucuugccgccccuuccuggguacaga

SEQ ID NO: 527506 - RNA, 32 nt, Human
uggugcugacaucaguggcuccuuguuugaug

SEQ ID NO: 527507 - RNA, 32 nt, Human
uggugcugauggagggagggggaagucgaagg

SEQ ID NO: 527508 - RNA, 32 nt, Human
uggugcugcaagaaaauggauaugguguugag

SEQ ID NO: 527509 - RNA, 32 nt, Human
uggugcugcaccacggggaccugcucucccug

SEQ ID NO: 527510 - RNA, 32 nt, Human
uggugcugcagauccagugggguccggacacu

SEQ ID NO: 527511 - RNA, 31 nt, Human
uggugcugccucuggcuuugucuuuccucag

SEQ ID NO: 527512 - RNA, 32 nt, Human
uggugcugcgaauccugccugcucugauccuc

SEQ ID NO: 527513 - RNA, 32 nt, Human
uggugcugcuacucgggaggaagcagagcagc

SEQ ID NO: 527514 - RNA, 32 nt, Human
uggugcugcucaccgucuuccuccuccugguc

SEQ ID NO: 527515 - RNA, 32 nt, Human
uggugcugcuguucuuuuuaauuucuuccuuu

SEQ ID NO: 527516 - RNA, 32 nt, Human
uggugcugcuucuguauauuuccacagcaucc

SEQ ID NO: 527517 - RNA, 32 nt, Human
uggugcuggagguggcugcagagagccacuug

SEQ ID NO: 527518 - RNA, 20 nt, Human
uggugcuggaucugggucau

SEQ ID NO: 527519 - RNA, 32 nt, Human
uggugcuggcgcugcacugggcugacugcggc

SEQ ID NO: 527520 - RNA, 32 nt, Human
uggugcuggcugcuguugggagcuccacugga

SEQ ID NO: 527521 - RNA, 32 nt, Human
uggugcugggccugagccagggggccgggaca

SEQ ID NO: 527522 - RNA, 32 nt, Human
uggugcugggcugugcccggcggcagcagcaa

SEQ ID NO: 527523 - RNA, 32 nt, Human
uggugcugggcuguugggagccgaaggcccau

SEQ ID NO: 527524 - RNA, 32 nt, Human
uggugcugggggaggcucccagcuacaccuug

SEQ ID NO: 527525 - RNA, 32 nt, Human
uggugcuggugacuuucuguuccuuuuggagu

SEQ ID NO: 527526 - RNA, 32 nt, Human
uggugcuggugcugcacugggcugacugcggc

SEQ ID NO: 527527 - RNA, 32 nt, Human
uggugcuguaagucuccuccuuccgagucugu

SEQ ID NO: 527528 - RNA, 32 nt, Human
uggugcuguguaugccucuggauguguccaga

SEQ ID NO: 527529 - RNA, 32 nt, Human
uggugcugugugccccacuccagccuggggac

SEQ ID NO: 527530 - RNA, 32 nt, Human
uggugcugugugugagcgagugacagaaggcc

SEQ ID NO: 527531 - RNA, 32 nt, Human
uggugcuguucccuccgcccugugccagggcc

SEQ ID NO: 527532 - RNA, 32 nt, Human
uggugcuguuucaaccuccguccccacaggag

SEQ ID NO: 527533 - RNA, 32 nt, Human
uggugcuucuccccacaccccuguaggccuca

SEQ ID NO: 527534 - RNA, 32 nt, Human
uggugcuucucucccaggcuguccucgggacc

SEQ ID NO: 527535 - RNA, 32 nt, Human
uggugcuucugccuuuaguuuuaggacacauu

SEQ ID NO: 527536 - RNA, 32 nt, Human
uggugcuucuguccuaggccaccacuccucca

SEQ ID NO: 527537 - RNA, 32 nt, Human
uggugcuugauuuccagaaacucuccagcgac

SEQ ID NO: 527538 - RNA, 32 nt, Human
uggugcuuggacgaccugcucucuacauugcu

SEQ ID NO: 527539 - RNA, 32 nt, Human
uggugcuugugagcauuugcuccaggauccgc

SEQ ID NO: 527540 - RNA, 32 nt, Human
uggugcuuucaugucugaaaauuuuccucuuc

SEQ ID NO: 527541 - RNA, 32 nt, Human
uggugcuuuccuucaucucccacgaacucaag

SEQ ID NO: 527542 - RNA, 23 nt, Human
uggugcuuuucacuuguguuuua

SEQ ID NO: 527543 - RNA, 32 nt, Human
uggugcuuuuguaccuagguuuuaugugauuu

SEQ ID NO: 527544 - RNA, 21 nt, Human
ugucacccagggugagugcaa

SEQ ID NO: 527545 - RNA, 24 nt, Human
ugucacccaggguggaauacagug

SEQ ID NO: 527546 - RNA, 32 nt, Human
ugucacccagguggcuggaguacaguggccug

SEQ ID NO: 527547 - RNA, 24 nt, Human
ugucacccagguuagaguguagug

SEQ ID NO: 527548 - RNA, 24 nt, Human
ugucacccagguucgaguucagug

SEQ ID NO: 527549 - RNA, 23 nt, Human
ugucacccagguuggagugcagu

SEQ ID NO: 527550 - RNA, 24 nt, Human
ugucacccagguuggagugcagug

SEQ ID NO: 527551 - RNA, 23 nt, Human
ugucacccagucuggagugcagu

SEQ ID NO: 527552 - RNA, 24 nt, Human
ugucacccagucuggagugcagug

SEQ ID NO: 527553 - RNA, 23 nt, Human
ugucacccaguuuggagugcagu

SEQ ID NO: 527554 - RNA, 24 nt, Human
ugucacccaguuuggagugcagug

SEQ ID NO: 527555 - RNA, 23 nt, Human
ugucacccauccuagagugcagu

SEQ ID NO: 527556 - RNA, 24 nt, Human
ugucacccauucuggaguacaaug

SEQ ID NO: 527557 - RNA, 32 nt, Human
ugucaccccacaacaggagggguuagcugugc

SEQ ID NO: 527558 - RNA, 32 nt, Human
ugucaccccugcacuccugccuucccgugggc

SEQ ID NO: 527559 - RNA, 24 nt, Human
ugucaccccugcugcuggagugca

SEQ ID NO: 527560 - RNA, 32 nt, Human
ugucaccccugcugcuggagugcaauugcaca

SEQ ID NO: 527561 - RNA, 32 nt, Human
ugucacccgagacaguaagagccaccccuccu

SEQ ID NO: 527562 - RNA, 23 nt, Human
ugucacccgagcuggagugcagu

SEQ ID NO: 527563 - RNA, 24 nt, Human
ugucacccgagcuggagugcagug

SEQ ID NO: 527564 - RNA, 23 nt, Human
ugucacccgggcuggagugcagu

SEQ ID NO: 527565 - RNA, 24 nt, Human
ugucacccgggcuggagugcagug

SEQ ID NO: 527566 - RNA, 21 nt, Human
ugucacccgggcuggagugua

SEQ ID NO: 527567 - RNA, 22 nt, Human
ugucacccgggcuggaguguaa

SEQ ID NO: 527568 - RNA, 32 nt, Human
ugucacccucacuuucacugcugguauugauu

SEQ ID NO: 527569 - RNA, 32 nt, Human
ugucacccuccagugacccgcagccaggaggu

SEQ ID NO: 527570 - RNA, 32 nt, Human
ugucacccugcccagaaaggccagcagcuugg

SEQ ID NO: 527571 - RNA, 23 nt, Human
ugucacccuggcuggagugcagu

SEQ ID NO: 527572 - RNA, 24 nt, Human
ugucaccgaggcuagaguacagug

SEQ ID NO: 527573 - RNA, 24 nt, Human
ugucaccgaggcuggagugcaaug

SEQ ID NO: 527574 - RNA, 23 nt, Human
ugucaccgaggcuggagugcagu

SEQ ID NO: 527575 - RNA, 24 nt, Human
ugucaccgaggcuggagugcagug

SEQ ID NO: 527576 - RNA, 24 nt, Human
ugucaccuaagcuggaguacagug

SEQ ID NO: 527577 - RNA, 32 nt, Human
ugucaccuaagcuggagugcagugcgcgaucu

SEQ ID NO: 527578 - RNA, 32 nt, Human
ugucaccuagacuagacuggagugcaauggcc

SEQ ID NO: 527579 - RNA, 24 nt, Human
ugucaccuagacuggagugcaaug

SEQ ID NO: 527580 - RNA, 24 nt, Human
ugucaccuaggcaagagugcaaug

SEQ ID NO: 527581 - RNA, 24 nt, Human
ugucaccuaggcuagagggcagug

SEQ ID NO: 527582 - RNA, 24 nt, Human
ugucaccuaggcugcagugcagug

SEQ ID NO: 527583 - RNA, 23 nt, Human
ugucaccuaggcuggaaugcagu

SEQ ID NO: 527584 - RNA, 24 nt, Human
ugucaccuaggcuggaaugcagug

SEQ ID NO: 527585 - RNA, 23 nt, Human
ugucaccuaggcuggagugcagu

SEQ ID NO: 527586 - RNA, 24 nt, Human
ugucaccuaggcuggagugcagug

SEQ ID NO: 527587 - RNA, 23 nt, Human
ugucaccuaggcuggauugcaau

SEQ ID NO: 527588 - RNA, 24 nt, Human
ugucaccuaggcuggauugcaaug

SEQ ID NO: 527589 - RNA, 32 nt, Human
ugucaccuagguccucuuugagccacauccgg

SEQ ID NO: 527590 - RNA, 24 nt, Human
ugucaccuagguuggagugcagug

SEQ ID NO: 527591 - RNA, 32 nt, Human
ugucaccucacagcaggagacagggaaacuga

SEQ ID NO: 527592 - RNA, 32 nt, Human
ugucaccuccugggcaggguucugggacccuc

SEQ ID NO: 527593 - RNA, 32 nt, Human
ugucaccugacuugaggagcuguuuuguuguu

SEQ ID NO: 527594 - RNA, 32 nt, Human
ugucaccugagccuguucuuucuguccuggug

SEQ ID NO: 527595 - RNA, 32 nt, Human
ugucaccugagggcuggcaggaaggggcgaga

SEQ ID NO: 527596 - RNA, 32 nt, Human
ugucaccugagucuaacagcaguuugacuuug

SEQ ID NO: 527597 - RNA, 32 nt, Human
ugucaccugcagcagagguggagugggggcca

SEQ ID NO: 527598 - RNA, 32 nt, Human
ugucaccugccugcccaggcagcuguuugcag

SEQ ID NO: 527599 - RNA, 32 nt, Human
ugucaccugccuggcuccugcucucugaugua

SEQ ID NO: 527600 - RNA, 32 nt, Human
ugucaccugcugcaacgcuguagccaaugaag

SEQ ID NO: 527601 - RNA, 32 nt, Human
ugucaccugggccuacacaggucccgagccaa

SEQ ID NO: 527602 - RNA, 24 nt, Human
ugucaccugggcuggaguccagug

SEQ ID NO: 527603 - RNA, 21 nt, Human
ugucaccugguugaagugcag

SEQ ID NO: 527604 - RNA, 32 nt, Human
ugucaccugugcacaucuugcugguggaggca

SEQ ID NO: 527605 - RNA, 32 nt, Human
ugucaccuuccaccccacaaggccaaccuuuu

SEQ ID NO: 527606 - RNA, 32 nt, Human
ugucaccuuccaugugcacuugcccaugggag

SEQ ID NO: 527607 - RNA, 32 nt, Human
ugucaccuugcuuccuaucugccucuuucgug

SEQ ID NO: 527608 - RNA, 32 nt, Human
ugucaccuuucuucuugugucuccuuauggua

SEQ ID NO: 527609 - RNA, 32 nt, Human
ugucaccuuugauuuauugauuuacuugagau

SEQ ID NO: 527610 - RNA, 32 nt, Human
ugucacgaacagggacagcaacaccgacacca

SEQ ID NO: 527611 - RNA, 32 nt, Human
ugucacgaccugcauggagacgccgcauggaa

SEQ ID NO: 527612 - RNA, 32 nt, Human
ugucacgacuaaccuucugucucugaaauugu

SEQ ID NO: 527613 - RNA, 32 nt, Human
ugucacgaugcccagacuuggagcaaggcaac

SEQ ID NO: 527614 - RNA, 24 nt, Human
ugucacgcaggcuagagugcagug

SEQ ID NO: 527615 - RNA, 32 nt, Human
ugucacgccuguaaucccaguacuuugggagg

SEQ ID NO: 527616 - RNA, 32 nt, Human
ugucacgcgccuguaaucccagcuacuugggg

SEQ ID NO: 527617 - RNA, 32 nt, Human
ugucacgcugauugucuguuuuuauagcaaaa

SEQ ID NO: 527618 - RNA, 32 nt, Human
ugucacgucaccuuuccaccuuccccgacccc

SEQ ID NO: 527619 - RNA, 32 nt, Human
ugucacgugcaggaacagugaggcagggacag

SEQ ID NO: 527620 - RNA, 22 nt, Human
ugucacguucuggaacauucug

SEQ ID NO: 527621 - RNA, 32 nt, Human
ugucacuaagcagcacgugacacuggcaggac

SEQ ID NO: 527622 - RNA, 32 nt, Human
ugucacuacaauauuacauucugcaaauguua

SEQ ID NO: 527623 - RNA, 32 nt, Human
ugucacuacacuccaggcugggugacagauua

SEQ ID NO: 527624 - RNA, 32 nt, Human
ugucacuacuaaaauuacaaaaauuagcaggg

SEQ ID NO: 527625 - RNA, 32 nt, Human
ugucacuagcagcugcagucaacaguucaaag

SEQ ID NO: 527626 - RNA, 32 nt, Human
ugucacuaggcaauucugucauuguguaaaca

SEQ ID NO: 527627 - RNA, 32 nt, Human
ugucacuagggcagggacaggauaagagggau

SEQ ID NO: 527628 - RNA, 32 nt, Human
ugucacuauguggcugucacgugaagugcugg

SEQ ID NO: 527629 - RNA, 32 nt, Human
ugucacucaacggucucggucuugucaucuuu

SEQ ID NO: 527630 - RNA, 24 nt, Human
ugucacucaaucuggaaugcagug

SEQ ID NO: 527631 - RNA, 23 nt, Human
ugucacucaggcuagagugcagu

SEQ ID NO: 527632 - RNA, 24 nt, Human
ugucacucaggcuagagugcagug

SEQ ID NO: 527633 - RNA, 24 nt, Human
ugucacucaggcugcagugcagug

SEQ ID NO: 527634 - RNA, 23 nt, Human
ugucacucaggcuggaaugcagu

SEQ ID NO: 527635 - RNA, 24 nt, Human
ugucacucaggcuggaaugcagug

SEQ ID NO: 527636 - RNA, 23 nt, Human
ugucacucaggcuggaguacagu

SEQ ID NO: 527637 - RNA, 24 nt, Human
ugucacucaggcuggaguacagug

SEQ ID NO: 527638 - RNA, 23 nt, Human
ugucacucaggcuggagugcaau

SEQ ID NO: 527639 - RNA, 24 nt, Human
ugucacucaggcuggagugcaaug

SEQ ID NO: 527640 - RNA, 23 nt, Human
ugucacucaggcuggagugcagu

SEQ ID NO: 527641 - RNA, 24 nt, Human
ugucacucaggcuggagugcagug

SEQ ID NO: 527642 - RNA, 24 nt, Human
ugucacucaggcuggagugcggug

SEQ ID NO: 527643 - RNA, 32 nt, Human
ugucacucauuucugaaaguuucuucagccac

SEQ ID NO: 527644 - RNA, 32 nt, Human
ugucacuccagccugggcaacagagugagacu

SEQ ID NO: 527645 - RNA, 23 nt, Human
ugucacuccucuuucccuuggua

SEQ ID NO: 527646 - RNA, 32 nt, Human
ugucacucuaagagcauccaagcccuggcccg

SEQ ID NO: 527647 - RNA, 32 nt, Human
ugucacucucaacacacacagcuccuuucacu

SEQ ID NO: 527648 - RNA, 32 nt, Human
ugucacucuguuuguuaggagaugucugcuuu

SEQ ID NO: 527649 - RNA, 23 nt, Human
ugucacugaggcuggagugcagu

SEQ ID NO: 527650 - RNA, 24 nt, Human
ugucacugaggcuggagugcagug

SEQ ID NO: 527651 - RNA, 32 nt, Human
ugucacugagucuacauguaucugaaacuagc

SEQ ID NO: 527652 - RNA, 32 nt, Human
ugucacugagugaaaucucuguuuucuauuuu

SEQ ID NO: 527653 - RNA, 32 nt, Human
ugucacugauugcauuccagccugggugacag

SEQ ID NO: 527654 - RNA, 32 nt, Human
ugucacugcacuccagccggggcaacagagca

SEQ ID NO: 527655 - RNA, 32 nt, Human
ugucacugcacuccagccuggcgacagaguga

SEQ ID NO: 527656 - RNA, 32 nt, Human
ugucacugcacuccagccugggcaacagguaa

SEQ ID NO: 527657 - RNA, 32 nt, Human
ugucacugcacuccagccugggcgacagaggg

SEQ ID NO: 527658 - RNA, 32 nt, Human
ugucacugcacuccagccugggcgacagagug

SEQ ID NO: 527659 - RNA, 32 nt, Human
ugucacugcacuccagccugggugacaagagu

SEQ ID NO: 527660 - RNA, 32 nt, Human
ugucacugcacuccagccugggugacagagug

SEQ ID NO: 527661 - RNA, 32 nt, Human
ugucacugcacuccagccugggugacagugag

SEQ ID NO: 527662 - RNA, 32 nt, Human
ugucacugcacuccagccuggugacagaguga

SEQ ID NO: 527663 - RNA, 32 nt, Human
ugucacugcacuccagcuugggugacagagac

SEQ ID NO: 527664 - RNA, 32 nt, Human
ugucacugcacuccauccugggugacaagagc

SEQ ID NO: 527665 - RNA, 32 nt, Human
ugucacugcagaagucuuccacaggccuucgc

SEQ ID NO: 527666 - RNA, 32 nt, Human
ugucacugccaaacaguaaccuccaggagaaa

SEQ ID NO: 527667 - RNA, 32 nt, Human
ugucacugcccucuccccaaccucuccucuaa

SEQ ID NO: 527668 - RNA, 32 nt, Human
ugucacugcccucucccugccugggggcuaug

SEQ ID NO: 527669 - RNA, 32 nt, Human
ugucacugcugcacucacucugcaagggauca

SEQ ID NO: 527670 - RNA, 32 nt, Human
ugucacugggcaagguggcucacaccuauaau

SEQ ID NO: 527671 - RNA, 32 nt, Human
ugucacuguacuccagccugggcaacagagug

SEQ ID NO: 527672 - RNA, 32 nt, Human
ugucacugucgcugcugccucuguccagcuga

SEQ ID NO: 527673 - RNA, 32 nt, Human
ugucacugucuuggccuugagaagagagcccg

SEQ ID NO: 527674 - RNA, 32 nt, Human
ugucacuguggaagcuugagcauguugcuuga

SEQ ID NO: 527675 - RNA, 32 nt, Human
ugucacuguggacgccaaaauggcauaacuga

SEQ ID NO: 527676 - RNA, 32 nt, Human
ugucacugugugacccucagcaagucacuaac

SEQ ID NO: 527677 - RNA, 32 nt, Human
ugucacuuaaguuuggagugcaguggcaugau

SEQ ID NO: 527678 - RNA, 32 nt, Human
ugucacuuaguucugugguuccagcagaucuc

SEQ ID NO: 527679 - RNA, 32 nt, Human
ugucacuucacacccauggcuaacccuggagg

SEQ ID NO: 527680 - RNA, 32 nt, Human
ugucacuucauacuugcaggauugcacagcag

SEQ ID NO: 527681 - RNA, 32 nt, Human
ugucacuugauuccauucucuccaucccuucc

SEQ ID NO: 527682 - RNA, 32 nt, Human
ugucacuuguagguuucucugccuccagguug

SEQ ID NO: 527683 - RNA, 32 nt, Human
ugucacuuucagcccgggacugcccagaugac

SEQ ID NO: 527684 - RNA, 32 nt, Human
ugucacuuuugcucucacuguuauguugaaua

SEQ ID NO: 527685 - RNA, 25 nt, Human
ugucagaaacgaugcugucuuccau

SEQ ID NO: 527686 - RNA, 32 nt, Human
ugucagaaagaggggaaggaagccagguugau

SEQ ID NO: 527687 - RNA, 32 nt, Human
ugucagaaccucuaaucuuaccucugggccag

SEQ ID NO: 527688 - RNA, 32 nt, Human
ugucagaaggggguuguggcaaaagccacauu

SEQ ID NO: 527689 - RNA, 32 nt, Human
ugucagaaugggcucaaggagccaucuuuugu

SEQ ID NO: 527690 - RNA, 22 nt, Human
ugucagaaugugaaaaguucug

SEQ ID NO: 527691 - RNA, 20 nt, Human
ugucagacaguuaguguagg

SEQ ID NO: 527692 - RNA, 20 nt, Human
ugucagacuauaggugugga

SEQ ID NO: 527693 - RNA, 32 nt, Human
ugucagaggcagcauggggcgccagugguccu

SEQ ID NO: 527694 - RNA, 32 nt, Human
ugucagagguagagaagacagggauugggaag

SEQ ID NO: 527695 - RNA, 32 nt, Human
ugucagagguggggcucagcaggaagugggac

SEQ ID NO: 527696 - RNA, 32 nt, Human
ugucagaucuccagguucuggagguuggaggu

SEQ ID NO: 527697 - RNA, 32 nt, Human
ugucagaucuguggcuucaggcaggaggaaag

SEQ ID NO: 527698 - RNA, 32 nt, Human
ugucagaugccuguagucccagcuacuuguga

SEQ ID NO: 527699 - RNA, 32 nt, Human
ugucagauguaaaggcacagcuggagcagagg

SEQ ID NO: 527700 - RNA, 20 nt, Human
ugucagauuuaugauaggaa

SEQ ID NO: 527701 - RNA, 32 nt, Human
ugucagauuugugucacucuucugccuucgug

SEQ ID NO: 527702 - RNA, 28 nt, Human
ugucagcaaacaguguggaaaaugccuu

SEQ ID NO: 527703 - RNA, 32 nt, Human
ugucagcaagcacaucagacucuagccuggac

SEQ ID NO: 527704 - RNA, 25 nt, Human
ugucagcacuggagucuucuugcug

SEQ ID NO: 527705 - RNA, 32 nt, Human
ugucagcacuuuuuccaaaaggcucacgaagu

SEQ ID NO: 527706 - RNA, 32 nt, Human
ugucagcagcacugagugccuaggugagccac

SEQ ID NO: 527707 - RNA, 32 nt, Human
ugucagcagccuggccuggucugugccugccc

SEQ ID NO: 527708 - RNA, 32 nt, Human
ugucagcagcuuuucauucagcugaaugcucu

SEQ ID NO: 527709 - RNA, 32 nt, Human
ugucagcaggcaggcuggggaggccaguguug

SEQ ID NO: 527710 - RNA, 32 nt, Human
ugucagcaguuggcccgggagacucuggagga

SEQ ID NO: 527711 - RNA, 21 nt, Human
ugucagcauaaugauagugaa

SEQ ID NO: 527712 - RNA, 32 nt, Human
ugucagcaucuucucacucccuucuccuugau

SEQ ID NO: 527713 - RNA, 32 nt, Human
ugucagccacccaggcccaacauguugugagu

SEQ ID NO: 527714 - RNA, 32 nt, Human
ugucagccaccgcacccagccuggaguggccu

SEQ ID NO: 527715 - RNA, 32 nt, Human
ugucagccaccucccucugccagucgggagag

SEQ ID NO: 527716 - RNA, 32 nt, Human
ugucagccacugcggccuuagagagagcugca

SEQ ID NO: 527717 - RNA, 32 nt, Human
ugucagccacugugauagaggcugaggaaucc

SEQ ID NO: 527718 - RNA, 24 nt, Human
ugucagccaggcuggagugcaaug

SEQ ID NO: 527719 - RNA, 24 nt, Human
ugucagccaggcuggagugcagug

SEQ ID NO: 527720 - RNA, 32 nt, Human
ugucagcccccacuccaggaaggcagcccaau

SEQ ID NO: 527721 - RNA, 32 nt, Human
ugucagccccuccuggugcuggugcccugaug

SEQ ID NO: 527722 - RNA, 32 nt, Human
ugucagccccuggccuagggggaagaagaauc

SEQ ID NO: 527723 - RNA, 32 nt, Human
ugucagccccuuccuuucccccgaccuaaaca

SEQ ID NO: 527724 - RNA, 19 nt, Human
ugucagcccuugaacaucu

SEQ ID NO: 527725 - RNA, 32 nt, Human
ugucagcccuugaacaucuccuccaaagagac

SEQ ID NO: 527726 - RNA, 32 nt, Human
ugucagccuaccagcucggagugcaguuccug

SEQ ID NO: 527727 - RNA, 32 nt, Human
ugucagccuggaccugccaagcugccugugca

SEQ ID NO: 527728 - RNA, 32 nt, Human
ugucagccuggagaccagcaccagaggaaucu

SEQ ID NO: 527729 - RNA, 32 nt, Human
ugucagccugggaaccggcccccaaauggaag

SEQ ID NO: 527730 - RNA, 32 nt, Human
ugucagccuuucuccuguuuauggguuucuuc

SEQ ID NO: 527731 - RNA, 32 nt, Human
ugucagcgcagccccagugcugugcuugaagc

SEQ ID NO: 527732 - RNA, 32 nt, Human
ugucagcggcagcugcucggcagcccagcccu

SEQ ID NO: 527733 - RNA, 24 nt, Human
ugucagcuaggcugaaguguagug

SEQ ID NO: 527734 - RNA, 32 nt, Human
ugucagcucacugcaaccuccaccuccuggau

SEQ ID NO: 527735 - RNA, 24 nt, Human
ugucagcucaugcuuacaaccugu

SEQ ID NO: 527736 - RNA, 20 nt, Human
ugucagcuccagauucauca

SEQ ID NO: 527737 - RNA, 32 nt, Human
ugucagcucccugcaaccuccgccuccugggu

SEQ ID NO: 527738 - RNA, 21 nt, Human
ugucagcucuagaggcacccu

SEQ ID NO: 527739 - RNA, 32 nt, Human
ugucagcucucauauucuuccagguuuugcac

SEQ ID NO: 527740 - RNA, 32 nt, Human
ugucagcucucaucugaggcauccagcagucu

SEQ ID NO: 527741 - RNA, 32 nt, Human
ugucagcugcagugggagacagcugcacaagg

SEQ ID NO: 527742 - RNA, 32 nt, Human
ugucagcugcuugugaaacucagccagguugu

SEQ ID NO: 527743 - RNA, 22 nt, Human
ugucagcuuaucuucuuugaua

SEQ ID NO: 527744 - RNA, 32 nt, Human
ugucagcuuuaaauccuucucacuuuccccac

SEQ ID NO: 527745 - RNA, 32 nt, Human
ugucagcuuuggauugcuggggccaggcccca

SEQ ID NO: 527746 - RNA, 32 nt, Human
ugucaggaaagcaugucagagcagagcugcca

SEQ ID NO: 527747 - RNA, 32 nt, Human
ugucaggaaaggaggugcuguuaugagcagcu

SEQ ID NO: 527748 - RNA, 32 nt, Human
ugucaggacaacacauauaaccaccaaggaug

SEQ ID NO: 527749 - RNA, 32 nt, Human
ugucaggacacauggauuuuggcagggcgggg

SEQ ID NO: 527750 - RNA, 32 nt, Human
ugucaggagagcaguggcacgggggcgugagg

SEQ ID NO: 527751 - RNA, 32 nt, Human
ugucaggagagggagagggggcugaggaggua

SEQ ID NO: 527752 - RNA, 32 nt, Human
ugucaggagaggggaaggcagccgcuuucacc

SEQ ID NO: 527753 - RNA, 32 nt, Human
ugucaggagcccaggucuccagcuggagggaa

SEQ ID NO: 527754 - RNA, 32 nt, Human
ugucaggaguugucuucaucugcagcacguuu

SEQ ID NO: 527755 - RNA, 32 nt, Human
ugucaggaugccaagaccaucaggagaggaca

SEQ ID NO: 527756 - RNA, 32 nt, Human
ugucaggcaauggggaaaggagagcucaggug

SEQ ID NO: 527757 - RNA, 32 nt, Human
ugucaggcaggcaucucuggauccagcugguu

SEQ ID NO: 527758 - RNA, 32 nt, Human
ugucaggcaguuuccaucuucucacaaucuuc

SEQ ID NO: 527759 - RNA, 32 nt, Human
ugucaggccaccgagguccaagccgcacuugc

SEQ ID NO: 527760 - RNA, 32 nt, Human
ugucaggccugucagucucaugacaguuuguu

SEQ ID NO: 527761 - RNA, 32 nt, Human
ugucaggccuugcccuucccaccagcaugucc

SEQ ID NO: 527762 - RNA, 32 nt, Human
ugucaggcggagagacccgccgccaggaauga

SEQ ID NO: 527763 - RNA, 32 nt, Human
ugucaggcucaaaccacuucucaggcaguuua

SEQ ID NO: 527764 - RNA, 32 nt, Human
ugucaggcucacugcccuuauuucucugccca

SEQ ID NO: 527765 - RNA, 32 nt, Human
ugucaggcucuccaccaaggagggacugggcc

SEQ ID NO: 527766 - RNA, 32 nt, Human
ugucaggcucugggcggagggcagcagccccu

SEQ ID NO: 527767 - RNA, 22 nt, Human
ugucaggcugcccacagcaaca

SEQ ID NO: 527768 - RNA, 32 nt, Human
ugucaggcugggguuagugagcagguuacacu

SEQ ID NO: 527769 - RNA, 32 nt, Human
ugucaggcuugcuuugccuugugggcuacuca

SEQ ID NO: 527770 - RNA, 32 nt, Human
ugucagggaaugacacucaucccccuucccaa

SEQ ID NO: 527771 - RNA, 32 nt, Human
ugucagggaguguucccuauccaaucaaucuu

SEQ ID NO: 527772 - RNA, 32 nt, Human
ugucagggcagagacgcccaaggcacugaacu

SEQ ID NO: 527773 - RNA, 22 nt, Human
ugucagggcagccagcuguaga

SEQ ID NO: 527774 - RNA, 30 nt, Human
ugucagggccucuccucacugcuguuguca

SEQ ID NO: 527775 - RNA, 32 nt, Human
ugucaggggcccuguccucaaccccgggucug

SEQ ID NO: 527776 - RNA, 32 nt, Human
ugucaggggcccuguccucaacccugggucug

SEQ ID NO: 527777 - RNA, 32 nt, Human
ugucagggucucaaacugccuaacacuuugua

SEQ ID NO: 527778 - RNA, 32 nt, Human
ugucagggugaggggugcaggagcgcagaggc

SEQ ID NO: 527779 - RNA, 32 nt, Human
ugucagguaaagccagaauaagagauaaaagg

SEQ ID NO: 527780 - RNA, 32 nt, Human
ugucaggucaccagauaaaggcaagucuuguc

SEQ ID NO: 527781 - RNA, 32 nt, Human
ugucaggugacagacagcuuggucacaacaca

SEQ ID NO: 527782 - RNA, 32 nt, Human
ugucaguaaacaggaaggaaggaggccaucug

SEQ ID NO: 527783 - RNA, 32 nt, Human
ugucaguaaagaaagagaaaauugcaucuugu

SEQ ID NO: 527784 - RNA, 32 nt, Human
ugucaguaacuuccauugauuaggcagacaua

SEQ ID NO: 527785 - RNA, 32 nt, Human
ugucaguacugcacugcaagaauggcagauuu

SEQ ID NO: 527786 - RNA, 23 nt, Human
ugucagucacaggagaacagcug

SEQ ID NO: 527787 - RNA, 32 nt, Human
ugucagucagggacaacaagauccuuaaugca

SEQ ID NO: 527788 - RNA, 32 nt, Human
ugucagucccaccuugaagacagaguuccagg

SEQ ID NO: 527789 - RNA, 32 nt, Human
ugucagucucagaaguuucaugcugagauaac

SEQ ID NO: 527790 - RNA, 32 nt, Human
ugucagucuccuccucugcguccucggccgcg

SEQ ID NO: 527791 - RNA, 26 nt, Human
ugucagugaacaaauaauaaugccuu

SEQ ID NO: 527792 - RNA, 20 nt, Human
ugucagugaagcugaugccu

SEQ ID NO: 527793 - RNA, 32 nt, Human
ugucagugagggugggguggaggacuccuaaa

SEQ ID NO: 527794 - RNA, 32 nt, Human
ugucagugagguugcaguuggucugggcuguu

SEQ ID NO: 527795 - RNA, 32 nt, Human
ugucagugauugaagggacacacuacuacuug

SEQ ID NO: 527796 - RNA, 32 nt, Human
ugucagugcauuugaggagacagcccccucuu

SEQ ID NO: 527797 - RNA, 32 nt, Human
ugucagugcuugugggaugcaguggucuucag

SEQ ID NO: 527798 - RNA, 32 nt, Human
ugucaguggaaaugccugccccagagggauau

SEQ ID NO: 527799 - RNA, 32 nt, Human
ugucaguggaggggucucugcagccaacugag

SEQ ID NO: 527800 - RNA, 29 nt, Human
ugucagugucugugucugugugugccugu

SEQ ID NO: 527801 - RNA, 29 nt, Human
ugucagugucuguguguugauggguggcc

SEQ ID NO: 527802 - RNA, 32 nt, Human
ugucaguucaccucuucugucguugucagagg

SEQ ID NO: 527803 - RNA, 32 nt, Human
ugucaguucaguuguugcucacugugguaauu

SEQ ID NO: 527804 - RNA, 32 nt, Human
ugucaguugccucauagccugcugguccugua

SEQ ID NO: 527805 - RNA, 20 nt, Human
ugucaguugcugcccuucac

SEQ ID NO: 527806 - RNA, 32 nt, Human
ugucaguuuacaccaauaguuucuuguuaauc

SEQ ID NO: 527807 - RNA, 32 nt, Human
ugucauaaaaggauucacacuggagagaaacc

SEQ ID NO: 527808 - RNA, 32 nt, Human
ugucauacacaaauguuccacaaggcgggagu

SEQ ID NO: 527809 - RNA, 32 nt, Human
ugucauacaggcuggcgugcaguagugggauc

SEQ ID NO: 527810 - RNA, 32 nt, Human
ugucauagccuuggaauaauuaagucucauga

SEQ ID NO: 527811 - RNA, 32 nt, Human
ugucauagcugcaggaggugauggcacaaugc

SEQ ID NO: 527812 - RNA, 32 nt, Human
ugucauagucuucucacuccuaauccaugacc

SEQ ID NO: 527813 - RNA, 32 nt, Human
ugucauagugguuuuuauuccugcuuuguuuc

SEQ ID NO: 527814 - RNA, 32 nt, Human
ugucauaguucuugccuucccuaaguuuauau

SEQ ID NO: 527815 - RNA, 32 nt, Human
ugucaucaacagugagcaaaucuggcauggug

SEQ ID NO: 527816 - RNA, 32 nt, Human
ugucaucacaaaaucucucaguaaggcuauau

SEQ ID NO: 527817 - RNA, 32 nt, Human
ugucaucacaugcaugcauaaaccggcaugug

SEQ ID NO: 527818 - RNA, 22 nt, Human
ugucaucaggcuggagugcagu

SEQ ID NO: 527819 - RNA, 23 nt, Human
ugucaucaggcuggagugcagug

SEQ ID NO: 527820 - RNA, 32 nt, Human
ugucaucaguuucugcuacguuucaaagaucc

SEQ ID NO: 527821 - RNA, 32 nt, Human
ugucaucaugccacugcacuuccagccugggu

SEQ ID NO: 527822 - RNA, 32 nt, Human
ugucaucauucagcuccaccuuccccgguccc

SEQ ID NO: 527823 - RNA, 32 nt, Human
ugucaucauugugacuuccugguagcccaaga

SEQ ID NO: 527824 - RNA, 23 nt, Human
ugucauccaaacuggagugcagu

SEQ ID NO: 527825 - RNA, 24 nt, Human
ugucauccaaacuggagugcagug

SEQ ID NO: 527826 - RNA, 32 nt, Human
ugucauccagaagucagagcagagugcgcaau

SEQ ID NO: 527827 - RNA, 32 nt, Human
ugucauccagacuggagcaguggugcaauuau

SEQ ID NO: 527828 - RNA, 32 nt, Human
ugucauccagagcuggagugcagcggcacagu

SEQ ID NO: 527829 - RNA, 23 nt, Human
ugucauccaggcuagagugcagu

SEQ ID NO: 527830 - RNA, 24 nt, Human
ugucauccaggcuagagugcagug

SEQ ID NO: 527831 - RNA, 23 nt, Human
ugucauccaggcuggagugcagu

SEQ ID NO: 527832 - RNA, 24 nt, Human
ugucauccaggcuggagugcagug

SEQ ID NO: 527833 - RNA, 23 nt, Human
ugucauccaggcuggagugcggu

SEQ ID NO: 527834 - RNA, 32 nt, Human
ugucauccaguauuaaguucuuagucauugau

SEQ ID NO: 527835 - RNA, 32 nt, Human
ugucauccgucuucaauauuuuuaaccagaaa

SEQ ID NO: 527836 - RNA, 32 nt, Human
ugucauccuauaggcaaaaagagcaagccagu

SEQ ID NO: 527837 - RNA, 32 nt, Human
ugucaucucagggagcuuaaaaugggcuugau

SEQ ID NO: 527838 - RNA, 32 nt, Human
ugucaucuccaagcugaguuuccucuucugag

SEQ ID NO: 527839 - RNA, 32 nt, Human
ugucaucuccaucuucacccuucagagagcag

SEQ ID NO: 527840 - RNA, 32 nt, Human
ugucaucucuacucuccucugccaugaggcca

SEQ ID NO: 527841 - RNA, 32 nt, Human
ugucaucucuacugggccauaggaccgggcaa

SEQ ID NO: 527842 - RNA, 32 nt, Human
ugucaucugcaaauaauuuuagccagguggca

SEQ ID NO: 527843 - RNA, 32 nt, Human
ugucaucugcuucuccccuguuggggcuaagg

SEQ ID NO: 527844 - RNA, 32 nt, Human
ugucaucuggcgcugaaagcaccaggacuggg

SEQ ID NO: 527845 - RNA, 32 nt, Human
ugucaucuggguagggcagagaggagggcuug

SEQ ID NO: 527846 - RNA, 32 nt, Human
ugucaucugucacccaggcuggagugcaguag

SEQ ID NO: 527847 - RNA, 32 nt, Human
ugucaucuguuaggaagccauucuaaagagaa

SEQ ID NO: 527848 - RNA, 32 nt, Human
ugucaucuguucuggggaucuguugcuguuuc

SEQ ID NO: 527849 - RNA, 32 nt, Human
ugucaucuucccugagaaaggcugcaguggcc

SEQ ID NO: 527850 - RNA, 32 nt, Human
ugucaugaaaucuggguugaaggagaauacag

SEQ ID NO: 527851 - RNA, 32 nt, Human
ugucaugaccaucacagcagaggagugacuuu

SEQ ID NO: 527852 - RNA, 32 nt, Human
ugucaugacggggacagagugagggaauggua

SEQ ID NO: 527853 - RNA, 32 nt, Human
ugucaugagcucugcugucuuagucaaucucu

SEQ ID NO: 527854 - RNA, 23 nt, Human
ugucaugcagacuggagugcagu

SEQ ID NO: 527855 - RNA, 24 nt, Human
ugucaugcagacuggagugcagug

SEQ ID NO: 527856 - RNA, 23 nt, Human
ugucaugcaggcuggagugcggu

SEQ ID NO: 527857 - RNA, 24 nt, Human
ugucaugcaggcuggagugcggug

SEQ ID NO: 527858 - RNA, 32 nt, Human
ugucaugcaguucuuuucuuuugcuagaaaau

SEQ ID NO: 527859 - RNA, 32 nt, Human
ugucaugcccgucucuggaauguccacuccca

SEQ ID NO: 527860 - RNA, 32 nt, Human
ugucaugccugcaaucccagcacuuugggagg

SEQ ID NO: 527861 - RNA, 29 nt, Human
ugucaugccugggagcccucggcccgcgc

SEQ ID NO: 527862 - RNA, 32 nt, Human
ugucaugcuccaaaucccacacugggcugcca

SEQ ID NO: 527863 - RNA, 32 nt, Human
ugucauggaagaggguggagccgccgcccgaa

SEQ ID NO: 527864 - RNA, 32 nt, Human
ugucauggaugccugugccaccccaggcaaua

SEQ ID NO: 527865 - RNA, 32 nt, Human
ugucauggcaugugccuguaaucccagcuacu

SEQ ID NO: 527866 - RNA, 32 nt, Human
ugucauggccuccugccacucuugaggcuguc

SEQ ID NO: 527867 - RNA, 23 nt, Human
ugucaugggagacuggagugcag

SEQ ID NO: 527868 - RNA, 32 nt, Human
ugucaugggcguccagcucaaaggccaccucc

SEQ ID NO: 527869 - RNA, 32 nt, Human
ugucaugggcuggggcucagauuuuccuggcu

SEQ ID NO: 527870 - RNA, 32 nt, Human
ugucauggggguggggacagggagccaccggu

SEQ ID NO: 527871 - RNA, 32 nt, Human
ugucauggggguggggacagggagucaccggu

SEQ ID NO: 527872 - RNA, 32 nt, Human
ugucaugggugucccucuguacucagaauggg

SEQ ID NO: 527873 - RNA, 32 nt, Human
ugucauggguuauugugaggauaaaacaaggc

SEQ ID NO: 527874 - RNA, 26 nt, Human
ugucaugguucuugcucaaguaccaa

SEQ ID NO: 527875 - RNA, 32 nt, Human
ugucaugguuggaagacagaguaggaaggaua

SEQ ID NO: 527876 - RNA, 32 nt, Human
ugucaugguuuaaauuauuaucuuggugaaau

SEQ ID NO: 527877 - RNA, 32 nt, Human
ugucauguacuggguaguaggagggagccuag

SEQ ID NO: 527878 - RNA, 32 nt, Human
ugucauguacuguauauuaccuggugauaguu

SEQ ID NO: 527879 - RNA, 32 nt, Human
ugucaugucccagauuucuguuuguaccagca

SEQ ID NO: 527880 - RNA, 21 nt, Human
ugucaugucuaaacuuuggaa

SEQ ID NO: 527881 - RNA, 32 nt, Human
ugucauguggugagucaaauaagaccauuuug

SEQ ID NO: 527882 - RNA, 32 nt, Human
ugucauguuggacacaagcagacucagcuuuu

SEQ ID NO: 527883 - RNA, 32 nt, Human
ugucauguugggcuccuggggcgggggcacgg

SEQ ID NO: 527884 - RNA, 32 nt, Human
ugucauuacuaucuaaaaccacugcagggaag

SEQ ID NO: 527885 - RNA, 32 nt, Human
ugucauuaguuucaggagaguauauaauucac

SEQ ID NO: 527886 - RNA, 32 nt, Human
ugucauuaucaucugcacuucacucaagagcu

SEQ ID NO: 527887 - RNA, 32 nt, Human
ugucauucaaagauguggcuguggauuucacc

SEQ ID NO: 527888 - RNA, 32 nt, Human
ugucauucaagaaccagguuugaguggccgcu

SEQ ID NO: 527889 - RNA, 32 nt, Human
ugucauucaaguuuucaucugcuuuauaauug

SEQ ID NO: 527890 - RNA, 21 nt, Human
ugucauucaaucauucuuccu

SEQ ID NO: 527891 - RNA, 32 nt, Human
ugucauucacacaccuacuuuucugcuucguu

SEQ ID NO: 527892 - RNA, 32 nt, Human
ugucauucagaaauaccauacugugaaugacc

SEQ ID NO: 527893 - RNA, 32 nt, Human
ugucauucagaacacagccacugugaaagugc

SEQ ID NO: 527894 - RNA, 32 nt, Human
ugucauucagcccaaacucauuacuuuauguu

SEQ ID NO: 527895 - RNA, 23 nt, Human
ugucauucaggcaagagugcagu

SEQ ID NO: 527896 - RNA, 23 nt, Human
ugucauucaggcuggagugcagu

SEQ ID NO: 527897 - RNA, 24 nt, Human
ugucauucaggcuggagugcagug

SEQ ID NO: 527898 - RNA, 32 nt, Human
ugucauucaggguuuccugacugcuaaugcag

SEQ ID NO: 527899 - RNA, 32 nt, Human
ugucauucaguuacucuuaauucuuuauaaaa

SEQ ID NO: 527900 - RNA, 32 nt, Human
ugucauucauucuuuacaauacucucaauuau

SEQ ID NO: 527901 - RNA, 32 nt, Human
ugucauucccagaggaaauguucucuucacgg

SEQ ID NO: 527902 - RNA, 32 nt, Human
ugucauuccccucuuuugucuuccucagcagg

SEQ ID NO: 527903 - RNA, 32 nt, Human
ugucauuccggccucagaucucuugugcccag

SEQ ID NO: 527904 - RNA, 32 nt, Human
ugucauuccucacauccugucauugucagaga

SEQ ID NO: 527905 - RNA, 32 nt, Human
ugucauucguuagucuacauguuucuaaacau

SEQ ID NO: 527906 - RNA, 32 nt, Human
ugucauucuagucacuuccugccuugugacca

SEQ ID NO: 527907 - RNA, 32 nt, Human
ugucauucuccaccauuucugcaguuuaucac

SEQ ID NO: 527908 - RNA, 32 nt, Human
ugucauucuggcuuacauauguuuuauuuaac

SEQ ID NO: 527909 - RNA, 32 nt, Human
ugucauucuucucuuacagaggggcaguagag

SEQ ID NO: 527910 - RNA, 32 nt, Human
ugucauucuuggaagguggcagagccaagagu

SEQ ID NO: 527911 - RNA, 32 nt, Human
ugucauugagucuucucucagaaucagcgagc

SEQ ID NO: 527912 - RNA, 32 nt, Human
ugucauugcacuccagccugggcaacaagagc

SEQ ID NO: 527913 - RNA, 32 nt, Human
ugucauugcacuccagccugggcgacaagagc

SEQ ID NO: 527914 - RNA, 32 nt, Human
ugucauugcacuccagccuggggaacagagcg

SEQ ID NO: 527915 - RNA, 32 nt, Human
ugucauugcacucuagucugggugacaagagc

SEQ ID NO: 527916 - RNA, 32 nt, Human
ugucauugcgccacugcaaaccagccugggca

SEQ ID NO: 527917 - RNA, 32 nt, Human
ugucauugucuucuccaccgggcuguucccau

SEQ ID NO: 527918 - RNA, 32 nt, Human
ugucauuguuaccagcagucuccaaacuggac

SEQ ID NO: 527919 - RNA, 32 nt, Human
ugucauuuacaagcaagcaggccaggcagcug

SEQ ID NO: 527920 - RNA, 32 nt, Human
ugucauuuaucagcaaaagauugggaauuuuc

SEQ ID NO: 527921 - RNA, 32 nt, Human
ugucauuuccugcugcuuccagcuccaucccu

SEQ ID NO: 527922 - RNA, 32 nt, Human
ugucauuugagcauccacaugaucagaccuga

SEQ ID NO: 527923 - RNA, 32 nt, Human
ugucauuugcacacaaaaauaaagacuagagc

SEQ ID NO: 527924 - RNA, 32 nt, Human
ugucauuugcucggagaucugcagugaguaaa

SEQ ID NO: 527925 - RNA, 32 nt, Human
ugucauuugcuggagcucugcccauccugccc

SEQ ID NO: 527926 - RNA, 32 nt, Human
ugucauuuggagcccauuaaaaagugaggcag

SEQ ID NO: 527927 - RNA, 32 nt, Human
ugucauuuuguuuauucuacugcaguagccag

SEQ ID NO: 527928 - RNA, 32 nt, Human
uguccaaaacacgcccuugggccccgccacgu

SEQ ID NO: 527929 - RNA, 32 nt, Human
uguccaaacuucuaaggcacagaaggaaacau

SEQ ID NO: 527930 - RNA, 32 nt, Human
uguccaaacuuuuggcuucccugggccacauu

SEQ ID NO: 527931 - RNA, 32 nt, Human
uguccaaagagggugaggggauuaggaaguac

SEQ ID NO: 527932 - RNA, 32 nt, Human
uguccaaagucccaggcccagugcaguccuug

SEQ ID NO: 527933 - RNA, 32 nt, Human
uguccaaauuaauaccaacagcauuucuggga

SEQ ID NO: 527934 - RNA, 32 nt, Human
uguccaacauggcgaaccucgucucuucuaaa

SEQ ID NO: 527935 - RNA, 23 nt, Human
uguccaaccagcuacccaccuca

SEQ ID NO: 527936 - RNA, 32 nt, Human
uguccaaccagcuguucucuccucaaagcagc

SEQ ID NO: 527937 - RNA, 32 nt, Human
uguccaaccccagcugauacagguuaucuagg

SEQ ID NO: 527938 - RNA, 32 nt, Human
uguccaaccucuggugcugaagcagccaagag

SEQ ID NO: 527939 - RNA, 32 nt, Human
uguccaaccucuggugcugaagcagccgagag

SEQ ID NO: 527940 - RNA, 32 nt, Human
uguccaaccuuuugucuucccugggccacauu

SEQ ID NO: 527941 - RNA, 32 nt, Human
uguccaagacacucucaggccuggaggcaggg

SEQ ID NO: 527942 - RNA, 32 nt, Human
uguccaagacagccuggcugggaaagggggug

SEQ ID NO: 527943 - RNA, 32 nt, Human
uguccaagagccuguuuuugaaacacaagcug

SEQ ID NO: 527944 - RNA, 32 nt, Human
uguccaagcaaaauggagcuggggaagauaac

SEQ ID NO: 527945 - RNA, 32 nt, Human
uguccaagccucccccuggcucuucaguucuc

SEQ ID NO: 527946 - RNA, 32 nt, Human
uguccaagccuccgggcagcagugccaucuuc

SEQ ID NO: 527947 - RNA, 32 nt, Human
uguccaaggagaacccggagaggcucugggcu

SEQ ID NO: 527948 - RNA, 21 nt, Human
uguccaaggcuggaguguagu

SEQ ID NO: 527949 - RNA, 32 nt, Human
uguccaaggcuggaguguaguagugcuaucac

SEQ ID NO: 527950 - RNA, 32 nt, Human
uguccaaggcuggaguguaguagugcuaucgc

SEQ ID NO: 527951 - RNA, 32 nt, Human
uguccaagggcaggaggaauggacagaagcau

SEQ ID NO: 527952 - RNA, 31 nt, Human
uguccaagugagaaagacugaguugcguguc

SEQ ID NO: 527953 - RNA, 32 nt, Human
uguccaaguguccaucaccaaugccaccggcc

SEQ ID NO: 527954 - RNA, 32 nt, Human
uguccaauccagccaagguucccuccacauau

SEQ ID NO: 527955 - RNA, 32 nt, Human
uguccaauccccgcgccccacacugcccagcg

SEQ ID NO: 527956 - RNA, 32 nt, Human
uguccaaucuuuuggcuucccugggccauacu

SEQ ID NO: 527957 - RNA, 32 nt, Human
uguccaaugcugccuucccaugaaucugucuc

SEQ ID NO: 527958 - RNA, 32 nt, Human
uguccaauugccaagaauauguuaacaauuaa

SEQ ID NO: 527959 - RNA, 32 nt, Human
uguccacaaucagccauuggccugucugggga

SEQ ID NO: 527960 - RNA, 32 nt, Human
uguccacacagcugccucagaagcgccgggcu

SEQ ID NO: 527961 - RNA, 32 nt, Human
uguccacacaguuagcggagcgcaggacuucu

SEQ ID NO: 527962 - RNA, 32 nt, Human
uguccacacaugcacaccagaugagggccaug

SEQ ID NO: 527963 - RNA, 18 nt, Human
uguccacaccacucucug

SEQ ID NO: 527964 - RNA, 21 nt, Human
uguccacacccaccucccugg

SEQ ID NO: 527965 - RNA, 18 nt, Human
uguccacacccccucgcu

SEQ ID NO: 527966 - RNA, 32 nt, Human
uguccacaccccuuauccccaggcuggugccc

SEQ ID NO: 527967 - RNA, 32 nt, Human
uguccacaccucugccccagagcugccuccug

SEQ ID NO: 527968 - RNA, 32 nt, Human
uguccacacucugcucucccugggcaggaaga

SEQ ID NO: 527969 - RNA, 23 nt, Human
uguccacacuugcuacucuuuga

SEQ ID NO: 527970 - RNA, 32 nt, Human
uguccacaguacacccucccucucccagccuc

SEQ ID NO: 527971 - RNA, 32 nt, Human
uguccacauauacaaccauacauacuugcaca

SEQ ID NO: 527972 - RNA, 32 nt, Human
uguccacaucaaggagaaucauagaacuguag

SEQ ID NO: 527973 - RNA, 32 nt, Human
uguccacaugugaacuuuuucuagguggcagg

SEQ ID NO: 527974 - RNA, 22 nt, Human
uguccacaugugugccuguaga

SEQ ID NO: 527975 - RNA, 32 nt, Human
uguccaccaccaacuucucagcauguuucucu

SEQ ID NO: 527976 - RNA, 32 nt, Human
uguccaccacuccacugugcucagggaaggca

SEQ ID NO: 527977 - RNA, 20 nt, Human
uguccaccacuccaucugcc

SEQ ID NO: 527978 - RNA, 32 nt, Human
uguccaccaggauaagugacaccuaggaccca

SEQ ID NO: 527979 - RNA, 32 nt, Human
uguccacccagccggccacugugugucauggc

SEQ ID NO: 527980 - RNA, 32 nt, Human
uguccacccccaucucccuugcucauuuggau

SEQ ID NO: 527981 - RNA, 32 nt, Human
uguccacccuaguccgagggcugcagucaacu

SEQ ID NO: 527982 - RNA, 32 nt, Human
uguccacccugaccaaucacuguggccaggag

SEQ ID NO: 527983 - RNA, 32 nt, Human
uguccacccugucccuguaucucccauggaag

SEQ ID NO: 527984 - RNA, 20 nt, Human
uguccacccuuccugccuca

SEQ ID NO: 527985 - RNA, 32 nt, Human
uguccacccuugcccucagcaagagagaaugc

SEQ ID NO: 527986 - RNA, 18 nt, Human
uguccaccgugaccccug

SEQ ID NO: 527987 - RNA, 32 nt, Human
uguccaccuccagggcccccaagcuacagggg

SEQ ID NO: 527988 - RNA, 32 nt, Human
uguccaccucccacccccaacccuccaccaga

SEQ ID NO: 527989 - RNA, 32 nt, Human
uguccaccugccagguggaguguauguggcug

SEQ ID NO: 527990 - RNA, 30 nt, Human
uguccaccugggcauauccaccaccucccu

SEQ ID NO: 527991 - RNA, 19 nt, Human
uguccaccuucccaucuca

SEQ ID NO: 527992 - RNA, 32 nt, Human
uguccaccuucccaucucaucuuaccuuaauc

SEQ ID NO: 527993 - RNA, 32 nt, Human
uguccaccuuucucuccucuucccaagccuuu

SEQ ID NO: 527994 - RNA, 32 nt, Human
uguccacgcugaggcacagccuggagaggggc

SEQ ID NO: 527995 - RNA, 32 nt, Human
uguccacguaguccucuccaucugcccguagc

SEQ ID NO: 527996 - RNA, 32 nt, Human
uguccacucagcacucuucucucuccaucucu

SEQ ID NO: 527997 - RNA, 32 nt, Human
uguccacuccaggccggacugacguagccuau

SEQ ID NO: 527998 - RNA, 20 nt, Human
uguccacucccagccuccca

SEQ ID NO: 527999 - RNA, 19 nt, Human
uguccacucccggccccau

SEQ ID NO: 528000 - RNA, 32 nt, Human
uguccacuccugcccucagucuggaccugccc

SEQ ID NO: 528001 - RNA, 32 nt, Human
uguccacugagcgggauugucugcugaguggg

SEQ ID NO: 528002 - RNA, 32 nt, Human
uguccacugcaaccuccacauccuggguucaa

SEQ ID NO: 528003 - RNA, 25 nt, Human
uguccacugcacuccucccaccuca

SEQ ID NO: 528004 - RNA, 20 nt, Human
uguccacugcccucccuggu

SEQ ID NO: 528005 - RNA, 32 nt, Human
uguccacugcucacgguggcagcugcuugggc

SEQ ID NO: 528006 - RNA, 32 nt, Human
uguccacugcuuucuaacaagauaauaaaccc

SEQ ID NO: 528007 - RNA, 32 nt, Human
uguccacuggagcagcucauugccagaggcag

SEQ ID NO: 528008 - RNA, 24 nt, Human
uguccacugucaccaagcuggaug

SEQ ID NO: 528009 - RNA, 32 nt, Human
uguccacuguggaaaggaucccagacugucgu

SEQ ID NO: 528010 - RNA, 32 nt, Human
uguccacuguucuguucucauagaggaaauuc

SEQ ID NO: 528011 - RNA, 32 nt, Human
uguccacuucuggagccaagaaagacaguucc

SEQ ID NO: 528012 - RNA, 32 nt, Human
uguccacuugcagauucaacaaaaagaguguu

SEQ ID NO: 528013 - RNA, 32 nt, Human
uguccacuugcagauucuacaaaaagaguguu

SEQ ID NO: 528014 - RNA, 19 nt, Human
uguccacuuuacaaaagaa

SEQ ID NO: 528015 - RNA, 32 nt, Human
uguccacuuucugcuuuucuuucuuucuuuuu

SEQ ID NO: 528016 - RNA, 32 nt, Human
uguccacuuugccucugcugcucugccagucu

SEQ ID NO: 528017 - RNA, 32 nt, Human
uguccagaaagacauucaccacugugguucaa

SEQ ID NO: 528018 - RNA, 24 nt, Human
uguccagaaccugcucccaccuca

SEQ ID NO: 528019 - RNA, 32 nt, Human
uguccagaagugaggaggaagagaagcuggug

SEQ ID NO: 528020 - RNA, 21 nt, Human
uguccagaccauugucuucca

SEQ ID NO: 528021 - RNA, 32 nt, Human
uguccagacuggucucaaacuccugggcucaa

SEQ ID NO: 528022 - RNA, 32 nt, Human
uguccagagccaaggcuucuaccuucauuguc

SEQ ID NO: 528023 - RNA, 32 nt, Human
uguccagagccccuccacagucggccucauga

SEQ ID NO: 528024 - RNA, 32 nt, Human
uguccagagcccugucucuuuucuggaauguc

SEQ ID NO: 528025 - RNA, 32 nt, Human
uguccagaggcugacguagacagugaagggug

SEQ ID NO: 528026 - RNA, 32 nt, Human
uguccagaggcugcucugaggcugaggugugu

SEQ ID NO: 528027 - RNA, 32 nt, Human
uguccagauggaaugacucccauccucuccuc

SEQ ID NO: 528028 - RNA, 32 nt, Human
uguccagauugggcucaggauggcaguugugg

SEQ ID NO: 528029 - RNA, 23 nt, Human
uguccagauuuccaaagcuggau

SEQ ID NO: 528030 - RNA, 31 nt, Human
uguccagcagugucucccacuccuugugaag

SEQ ID NO: 528031 - RNA, 32 nt, Human
uguccagcaguucuguauauacucagaaugaa

SEQ ID NO: 528032 - RNA, 32 nt, Human
uguccagcaugaaccucagaccuaucuugagc

SEQ ID NO: 528033 - RNA, 18 nt, Human
uguccagccaggggcaga

SEQ ID NO: 528034 - RNA, 18 nt, Human
uguccagccagguugagc

SEQ ID NO: 528035 - RNA, 32 nt, Human
uguccagcccagcaugaguagcagguagagca

SEQ ID NO: 528036 - RNA, 32 nt, Human
uguccagcccagugccugggcucugggaccuc

SEQ ID NO: 528037 - RNA, 32 nt, Human
uguccagccccacaugucaauucuggagagga

SEQ ID NO: 528038 - RNA, 32 nt, Human
uguccagcccccaccccaccuccugggacccu

SEQ ID NO: 528039 - RNA, 32 nt, Human
uguccagccugaccaacauggugaaaccccau

SEQ ID NO: 528040 - RNA, 32 nt, Human
uguccagccugaguuccagccucacugagugg

SEQ ID NO: 528041 - RNA, 32 nt, Human
uguccagccugccucuucccaggcuggucuga

SEQ ID NO: 528042 - RNA, 32 nt, Human
uguccagccuggcucccuuccugggccuggcu

SEQ ID NO: 528043 - RNA, 32 nt, Human
uguccagcgcggcucccgccacccucaauaaa

SEQ ID NO: 528044 - RNA, 32 nt, Human
uguccagcucccccaaacccugcagagugcug

SEQ ID NO: 528045 - RNA, 32 nt, Human
uguccagcugcacucuccucuccugggaccca

SEQ ID NO: 528046 - RNA, 32 nt, Human
uguccagcuguggcuauggccccagccccgag

SEQ ID NO: 528047 - RNA, 32 nt, Human
uguccaggaacuuuccagcaguauccucgcug

SEQ ID NO: 528048 - RNA, 19 nt, Human
uguccaggacacugaaaug

SEQ ID NO: 528049 - RNA, 21 nt, Human
uguccaggacagcaaugggaa

SEQ ID NO: 528050 - RNA, 32 nt, Human
uguccaggagggagaggaccuccacccucuga

SEQ ID NO: 528051 - RNA, 21 nt, Human
uguccaggauggagugcagug

SEQ ID NO: 528052 - RNA, 32 nt, Human
uguccaggccaucauggccuccacugccggcu

SEQ ID NO: 528053 - RNA, 32 nt, Human
uguccaggcuacagagggugacuccagguucc

SEQ ID NO: 528054 - RNA, 21 nt, Human
uguccaggcuagagugcagug

SEQ ID NO: 528055 - RNA, 21 nt, Human
uguccaggcuggaguauaaug

SEQ ID NO: 528056 - RNA, 20 nt, Human
uguccaggcuggagugcaau

SEQ ID NO: 528057 - RNA, 21 nt, Human
uguccaggcuggagugcaaug

SEQ ID NO: 528058 - RNA, 19 nt, Human
uguccaggcuggagugcag

SEQ ID NO: 528059 - RNA, 20 nt, Human
uguccaggcuggagugcagu

SEQ ID NO: 528060 - RNA, 21 nt, Human
uguccaggcuggagugcagug

SEQ ID NO: 528061 - RNA, 32 nt, Human
uguccaggcuggccuugagcuccugggcucaa

SEQ ID NO: 528062 - RNA, 32 nt, Human
uguccaggcuggucccgaacuccugaccucag

SEQ ID NO: 528063 - RNA, 32 nt, Human
uguccaggcuggucuugaaccccugaccucaa

SEQ ID NO: 528064 - RNA, 32 nt, Human
uguccagggccagcuccugccucccggugccc

SEQ ID NO: 528065 - RNA, 32 nt, Human
uguccagggccagcucuugccucccggcggcc

SEQ ID NO: 528066 - RNA, 32 nt, Human
uguccaggggagggcccugccacccacaauuc

SEQ ID NO: 528067 - RNA, 32 nt, Human
uguccaggggcagcccuccuucccaggugugg

SEQ ID NO: 528068 - RNA, 20 nt, Human
uguccagguaaaaaugugaa

SEQ ID NO: 528069 - RNA, 32 nt, Human
uguccagguccugguggggaguggggcccuug

SEQ ID NO: 528070 - RNA, 32 nt, Human
uguccaggugcgcugggaaggguccuggcggu

SEQ ID NO: 528071 - RNA, 32 nt, Human
uguccagguggccccugaauucugcgcaaggg

SEQ ID NO: 528072 - RNA, 32 nt, Human
uguccaguagcaugaacaccgcgaacagccuc

SEQ ID NO: 528073 - RNA, 32 nt, Human
uguccaguccccagccuggccccaccagccca

SEQ ID NO: 528074 - RNA, 21 nt, Human
uguccagucuggagugcaaug

SEQ ID NO: 528075 - RNA, 32 nt, Human
uguccagugacuuagaguacauagaagaaaau

SEQ ID NO: 528076 - RNA, 32 nt, Human
uguccagugcaguagccacuacccauauguag

SEQ ID NO: 528077 - RNA, 32 nt, Human
uguccagugcauacccugccccucucugucgu

SEQ ID NO: 528078 - RNA, 32 nt, Human
uguccaguggaacgaagacuaaccucaccagc

SEQ ID NO: 528079 - RNA, 32 nt, Human
uguccaguggccacaguccuuguccaagccuc

SEQ ID NO: 528080 - RNA, 32 nt, Human
uguccaguguguacccugccccucucugucgu

SEQ ID NO: 528081 - RNA, 32 nt, Human
uguccaguucuccuccacaucucccaucccag

SEQ ID NO: 528082 - RNA, 32 nt, Human
uguccauagcuuugguugggccugugucacau

SEQ ID NO: 528083 - RNA, 31 nt, Human
uguccauaggaguccaucaaggcagagcggc

SEQ ID NO: 528084 - RNA, 32 nt, Human
uguccaucaagaaauuauggaagugguggaca

SEQ ID NO: 528085 - RNA, 18 nt, Human
uguccauccagcaccugg

SEQ ID NO: 528086 - RNA, 32 nt, Human
uguccaucccacagcucagccuggaugcccac

SEQ ID NO: 528087 - RNA, 32 nt, Human
uguccaucccuaauaccugucaccuuguccuu

SEQ ID NO: 528088 - RNA, 21 nt, Human
uguccaucuauaaacauguca

SEQ ID NO: 528089 - RNA, 32 nt, Human
uguccaucuggucuaagguggcugcuucuucc

SEQ ID NO: 528090 - RNA, 32 nt, Human
uguccaugaauccucuguggcaacuguaauca

SEQ ID NO: 528091 - RNA, 32 nt, Human
uguccaugagggagagguugcugagaaguaca

SEQ ID NO: 528092 - RNA, 32 nt, Human
uguccaugcagguguuggaagggagagcugaa

SEQ ID NO: 528093 - RNA, 32 nt, Human
uguccaugccagggaugccacagggggcccca

SEQ ID NO: 528094 - RNA, 32 nt, Human
uguccaugucaucugggagcagccuggguucc

SEQ ID NO: 528095 - RNA, 32 nt, Human
uguccaugugugaccaugugucugugaggcag

SEQ ID NO: 528096 - RNA, 32 nt, Human
uguccauucuuugccuuccuggagcucccagc

SEQ ID NO: 528097 - RNA, 32 nt, Human
uguccauuuuccagaauguauuuccaagccca

SEQ ID NO: 528098 - RNA, 21 nt, Human
ugucccaaaucccuuuagcca

SEQ ID NO: 528099 - RNA, 32 nt, Human
ugucccaacuuguggugggagcuggggcaagg

SEQ ID NO: 528100 - RNA, 20 nt, Human
ugucccaagccaucccugcu

SEQ ID NO: 528101 - RNA, 32 nt, Human
ugucccaaggagaaaagcugcaggcaucugag

SEQ ID NO: 528102 - RNA, 32 nt, Human
ugucccaaguuccagccgcgucccuggggccu

SEQ ID NO: 528103 - RNA, 32 nt, Human
ugucccaaucacugugccaggagauuuaccug

SEQ ID NO: 528104 - RNA, 28 nt, Human
ugucccacaacucuggccucaucgcccu

SEQ ID NO: 528105 - RNA, 32 nt, Human
ugucccacacagauagcagccucuugcuugcc

SEQ ID NO: 528106 - RNA, 32 nt, Human
ugucccacagaacuucccacuguggaucugug

SEQ ID NO: 528107 - RNA, 32 nt, Human
ugucccacagcagccacuugagggcagggcug

SEQ ID NO: 528108 - RNA, 32 nt, Human
ugucccaccacaacugaaccagaagagaguga

SEQ ID NO: 528109 - RNA, 32 nt, Human
ugucccaccacucauucucagcuuugaauggg

SEQ ID NO: 528110 - RNA, 32 nt, Human
ugucccaccagguccuggaggcagaugcgagg

SEQ ID NO: 528111 - RNA, 21 nt, Human
ugucccacccacccgccgccu

SEQ ID NO: 528112 - RNA, 17 nt, Human
ugucccaccuccucccu

SEQ ID NO: 528113 - RNA, 32 nt, Human
ugucccacguuuacacuccacacucacaccuc

SEQ ID NO: 528114 - RNA, 32 nt, Human
ugucccacucacuguuccaggaauucuugcag

SEQ ID NO: 528115 - RNA, 32 nt, Human
ugucccacuccucuggggccucaggccauaau

SEQ ID NO: 528116 - RNA, 32 nt, Human
ugucccacugcacagucggccauagggacgug

SEQ ID NO: 528117 - RNA, 32 nt, Human
ugucccagaaaccgucccugaagaaaccggac

SEQ ID NO: 528118 - RNA, 32 nt, Human
ugucccagaccccucuauucugcuccaggaca

SEQ ID NO: 528119 - RNA, 32 nt, Human
ugucccagagcaggccagcccgcgugggccga

SEQ ID NO: 528120 - RNA, 32 nt, Human
ugucccagagccgccuaaacgcaagaaaaguc

SEQ ID NO: 528121 - RNA, 32 nt, Human
ugucccagcaagucucucuccccaaagcagca

SEQ ID NO: 528122 - RNA, 32 nt, Human
ugucccagccacaggcuucuuguccaccucuu

SEQ ID NO: 528123 - RNA, 32 nt, Human
ugucccagccuccaacucaucuccuuccuguc

SEQ ID NO: 528124 - RNA, 32 nt, Human
ugucccagccuggaccuggcuuccugccucac

SEQ ID NO: 528125 - RNA, 32 nt, Human
ugucccagccugggcaacauagcaagacccug

SEQ ID NO: 528126 - RNA, 32 nt, Human
ugucccagcuacucaggaggcugaggcaggag

SEQ ID NO: 528127 - RNA, 32 nt, Human
ugucccagcuacucgggaggcugaggcaggag

SEQ ID NO: 528128 - RNA, 32 nt, Human
ugucccagcucugcucuaggacugccucccac

SEQ ID NO: 528129 - RNA, 32 nt, Human
ugucccaggagaauuguuagugaccccucuuu

SEQ ID NO: 528130 - RNA, 24 nt, Human
ugucccaggagcaaaugcuggaug

SEQ ID NO: 528131 - RNA, 32 nt, Human
ugucccaggcagcacagugugugaacugcuuu

SEQ ID NO: 528132 - RNA, 26 nt, Human
ugucccaggcccagggaccucugccg

SEQ ID NO: 528133 - RNA, 32 nt, Human
ugucccaggccugggcgugguggaggaagggg

SEQ ID NO: 528134 - RNA, 32 nt, Human
ugucccaggccuguugccagaugaggccacgc

SEQ ID NO: 528135 - RNA, 21 nt, Human
ugucccaggcuagagugcagu

SEQ ID NO: 528136 - RNA, 22 nt, Human
ugucccaggcuagagugcagug

SEQ ID NO: 528137 - RNA, 32 nt, Human
ugucccaggcuggaagguggagcgagaagugg

SEQ ID NO: 528138 - RNA, 22 nt, Human
ugucccaggcuggagugcagug

SEQ ID NO: 528139 - RNA, 32 nt, Human
ugucccaggcuggagugcaguggcacagucuc

SEQ ID NO: 528140 - RNA, 32 nt, Human
ugucccagggccuccaugucagccaggaauuc

SEQ ID NO: 528141 - RNA, 31 nt, Human
ugucccaggguggaagguggggagggggccg

SEQ ID NO: 528142 - RNA, 32 nt, Human
ugucccaucacaccugagaugucagacauggg

SEQ ID NO: 528143 - RNA, 32 nt, Human
ugucccaugaagcccucuccucagcuuuacuu

SEQ ID NO: 528144 - RNA, 20 nt, Human
ugucccaugacuuguucugg

SEQ ID NO: 528145 - RNA, 32 nt, Human
ugucccaugauccccucucuuccuccccaccc

SEQ ID NO: 528146 - RNA, 32 nt, Human
ugucccaugcccacccuccccacgcugcagug

SEQ ID NO: 528147 - RNA, 32 nt, Human
uguccccaaaccuauggaaguuguugcuauac

SEQ ID NO: 528148 - RNA, 24 nt, Human
uguccccaaggcuggagugcagug

SEQ ID NO: 528149 - RNA, 32 nt, Human
uguccccaaucagcaaguggucgugccuggcu

SEQ ID NO: 528150 - RNA, 21 nt, Human
uguccccacauccugauagcc

SEQ ID NO: 528151 - RNA, 21 nt, Human
uguccccacccaugcgccuuc

SEQ ID NO: 528152 - RNA, 18 nt, Human
uguccccaccccauccca

SEQ ID NO: 528153 - RNA, 20 nt, Human
uguccccaccucagugccug

SEQ ID NO: 528154 - RNA, 32 nt, Human
uguccccaccucagugccugcggggcccugag

SEQ ID NO: 528155 - RNA, 22 nt, Human
uguccccaccuccccagccuuc

SEQ ID NO: 528156 - RNA, 17 nt, Human
uguccccaccuccuccc

SEQ ID NO: 528157 - RNA, 32 nt, Human
uguccccaccuccuccccaugggcaccaucuc

SEQ ID NO: 528158 - RNA, 23 nt, Human
uguccccaccucucccagccugu

SEQ ID NO: 528159 - RNA, 32 nt, Human
uguccccacgucuuggccauucaccucugaaa

SEQ ID NO: 528160 - RNA, 32 nt, Human
uguccccacuguaccagccucugauaagcugc

SEQ ID NO: 528161 - RNA, 31 nt, Human
uguccccagagaggaggauguggugagcccc

SEQ ID NO: 528162 - RNA, 32 nt, Human
uguccccagagaggaggauguggugagccccg

SEQ ID NO: 528163 - RNA, 32 nt, Human
uguccccagagcugcuuguggguuucuggggu

SEQ ID NO: 528164 - RNA, 32 nt, Human
uguccccagaggcaaggaacuaugugagccac

SEQ ID NO: 528165 - RNA, 32 nt, Human
uguccccagcuggggugagcgcucagagggcc

SEQ ID NO: 528166 - RNA, 32 nt, Human
uguccccagcuguguccagccugucugcaggg

SEQ ID NO: 528167 - RNA, 32 nt, Human
uguccccagcuucugauggcagccaggagaau

SEQ ID NO: 528168 - RNA, 32 nt, Human
uguccccaggagcugggaugccaggucgauuu

SEQ ID NO: 528169 - RNA, 32 nt, Human
uguccccaggauggccagcuugaggaugaagu

SEQ ID NO: 528170 - RNA, 32 nt, Human
uguccccaggcucacucagccuggcggccaug

SEQ ID NO: 528171 - RNA, 32 nt, Human
uguccccaggcuggagaaucgcuugacccagg

SEQ ID NO: 528172 - RNA, 32 nt, Human
uguccccagggugggggaagggccaggcagag

SEQ ID NO: 528173 - RNA, 32 nt, Human
uguccccaguauuuauugaacagcugucuaug

SEQ ID NO: 528174 - RNA, 32 nt, Human
uguccccaguggaggcauggccagcaucugcu

SEQ ID NO: 528175 - RNA, 32 nt, Human
uguccccaguuccugaggacaaagggccuggc

SEQ ID NO: 528176 - RNA, 18 nt, Human
uguccccaucaaaaagaa

SEQ ID NO: 528177 - RNA, 24 nt, Human
uguccccauccaaauaucaccuua

SEQ ID NO: 528178 - RNA, 22 nt, Human
uguccccauccccccacugccu

SEQ ID NO: 528179 - RNA, 18 nt, Human
uguccccauccgccuuca

SEQ ID NO: 528180 - RNA, 22 nt, Human
uguccccauccugggaagccug

SEQ ID NO: 528181 - RNA, 19 nt, Human
uguccccaucugucggccu

SEQ ID NO: 528182 - RNA, 32 nt, Human
uguccccaugagcaauaaaacucucuccuuau

SEQ ID NO: 528183 - RNA, 21 nt, Human
uguccccaugcaccuugcuca

SEQ ID NO: 528184 - RNA, 32 nt, Human
uguccccaugggcucccacugcagccucgagu

SEQ ID NO: 528185 - RNA, 24 nt, Human
ugucccccaagcuggaguacaaug

SEQ ID NO: 528186 - RNA, 18 nt, Human
ugucccccacagaccugc

SEQ ID NO: 528187 - RNA, 32 nt, Human
ugucccccacccacugccaaguacaaugaccu

SEQ ID NO: 528188 - RNA, 32 nt, Human
ugucccccagaggccuugggcugcaguugcag

SEQ ID NO: 528189 - RNA, 22 nt, Human
ugucccccaggaucccacuccu

SEQ ID NO: 528190 - RNA, 22 nt, Human
ugucccccaggcugaagugcag

SEQ ID NO: 528191 - RNA, 19 nt, Human
ugucccccaggcuggagug

SEQ ID NO: 528192 - RNA, 23 nt, Human
ugucccccaggcuggagugcagu

SEQ ID NO: 528193 - RNA, 24 nt, Human
ugucccccaggcuggagugcagug

SEQ ID NO: 528194 - RNA, 24 nt, Human
ugucccccaggcuggagugcgaug

SEQ ID NO: 528195 - RNA, 32 nt, Human
ugucccccaggcuggaguggugcaguggcacg

SEQ ID NO: 528196 - RNA, 24 nt, Human
ugucccccaggcuugagugcaaug

SEQ ID NO: 528197 - RNA, 20 nt, Human
ugucccccauccccaccgcc

SEQ ID NO: 528198 - RNA, 20 nt, Human
uguccccccacacccgucca

SEQ ID NO: 528199 - RNA, 22 nt, Human
uguccccccagacugugagcuc

SEQ ID NO: 528200 - RNA, 23 nt, Human
uguccccccaggcaucuucacuc

SEQ ID NO: 528201 - RNA, 21 nt, Human
uguccccccaggccguguaca

SEQ ID NO: 528202 - RNA, 22 nt, Human
uguccccccaggccucuccuca

SEQ ID NO: 528203 - RNA, 20 nt, Human
uguccccccaugccuggccc

SEQ ID NO: 528204 - RNA, 20 nt, Human
uguccccccgccccccguca

SEQ ID NO: 528205 - RNA, 32 nt, Human
ugucccccgccccgccucuccaaaaagcuaca

SEQ ID NO: 528206 - RNA, 25 nt, Human
ugucccccgcccgccgcuucugucc

SEQ ID NO: 528207 - RNA, 32 nt, Human
ugucccccgccuccuccuccccauuuccgggc

SEQ ID NO: 528208 - RNA, 32 nt, Human
ugucccccgugcacgguucaaugguagauucg

SEQ ID NO: 528209 - RNA, 32 nt, Human
ugucccccuacccuaaaccccaguuagguacc

SEQ ID NO: 528210 - RNA, 32 nt, Human
ugucccccuccccucuuagccccucagugugu

SEQ ID NO: 528211 - RNA, 22 nt, Human
ugucccccucccugaacuuccu

SEQ ID NO: 528212 - RNA, 22 nt, Human
ugucccccucuuagccccugcc

SEQ ID NO: 528213 - RNA, 32 nt, Human
ugucccccugcaaaccugcuugcugaccucag

SEQ ID NO: 528214 - RNA, 32 nt, Human
ugucccccugcagguggagcugcugggcugcg

SEQ ID NO: 528215 - RNA, 32 nt, Human
ugucccccugucagcugccuccagaagggaag

SEQ ID NO: 528216 - RNA, 21 nt, Human
ugucccccugucgccacugcu

SEQ ID NO: 528217 - RNA, 32 nt, Human
ugucccccuuucucccaaggccuccugaagcg

SEQ ID NO: 528218 - RNA, 32 nt, Human
uguccccgccauguggcccccuuguuccaggg

SEQ ID NO: 528219 - RNA, 23 nt, Human
uguccccggcagccagugcucuc

SEQ ID NO: 528220 - RNA, 32 nt, Human
uguccccguuuccccucccccuucccuucucc

SEQ ID NO: 528221 - RNA, 19 nt, Human
uguccccuaagcaccuggu

SEQ ID NO: 528222 - RNA, 24 nt, Human
uguccccuaggcugcagugcagug

SEQ ID NO: 528223 - RNA, 31 nt, Human
uguccccucaaaaucucauguugaaauguga

SEQ ID NO: 528224 - RNA, 32 nt, Human
uguccccucacagggaggggagcaggggaggg

SEQ ID NO: 528225 - RNA, 22 nt, Human
uguccccucauccccaguagcc

SEQ ID NO: 528226 - RNA, 32 nt, Human
uguccccuccacccucacuccauccaccucgg

SEQ ID NO: 528227 - RNA, 21 nt, Human
uguccccucccacccgccuca

SEQ ID NO: 528228 - RNA, 24 nt, Human
uguccccucccccaccacacaccu

SEQ ID NO: 528229 - RNA, 32 nt, Human
uguccccuccuacuucuugcugccucacgguu

SEQ ID NO: 528230 - RNA, 32 nt, Human
uguccccuccucccccuccacagccccugagg

SEQ ID NO: 528231 - RNA, 32 nt, Human
uguccccuccuuuccucccuccuuccuuccac

SEQ ID NO: 528232 - RNA, 32 nt, Human
uguccccucuacucugccacguaggcccguca

SEQ ID NO: 528233 - RNA, 32 nt, Human
uguccccucucauccuauucugugccaaaugu

SEQ ID NO: 528234 - RNA, 32 nt, Human
uguccccugacacuccacagugugccugcaac

SEQ ID NO: 528235 - RNA, 32 nt, Human
uguccccugcagcuuccguggugccuuugcug

SEQ ID NO: 528236 - RNA, 32 nt, Human
uguccccugcccuccccuccccaacuaccccc

SEQ ID NO: 528237 - RNA, 32 nt, Human
uguccccugccugcguccuggggccugugcac

SEQ ID NO: 528238 - RNA, 32 nt, Human
uguccccugcuccccuccuaccacuguccagg

SEQ ID NO: 528239 - RNA, 32 nt, Human
uguccccugcugagaaauggagagcucuuuuc

SEQ ID NO: 528240 - RNA, 32 nt, Human
uguccccugcugcucugaggggagaggggugg

SEQ ID NO: 528241 - RNA, 32 nt, Human
uguccccuggaaaagccauaagaugggaccca

SEQ ID NO: 528242 - RNA, 22 nt, Human
uguccccuggagccccacugcc

SEQ ID NO: 528243 - RNA, 32 nt, Human
uguccccuggagugugucagagcccaggggag

SEQ ID NO: 528244 - RNA, 32 nt, Human
uguccccugggaacugcaagaugcacaggacc

SEQ ID NO: 528245 - RNA, 32 nt, Human
uguccccuuccaccugcccucucccccaaagc

SEQ ID NO: 528246 - RNA, 23 nt, Human
uguccccuuccccacccacugcc

SEQ ID NO: 528247 - RNA, 24 nt, Human
uguccccuuccccacccacugccu

SEQ ID NO: 528248 - RNA, 20 nt, Human
uguccccuuccccacccucu

SEQ ID NO: 528249 - RNA, 22 nt, Human
uguccccuucccccaccuuccu

SEQ ID NO: 528250 - RNA, 22 nt, Human
uguccccuuccccguguaugcc

SEQ ID NO: 528251 - RNA, 21 nt, Human
uguccccuuccccuccccucc

SEQ ID NO: 528252 - RNA, 19 nt, Human
uguccccuuccccugugcc

SEQ ID NO: 528253 - RNA, 22 nt, Human
uguccccuuccucuccucugcc

SEQ ID NO: 528254 - RNA, 21 nt, Human
uguccccuuccugucugccca

SEQ ID NO: 528255 - RNA, 20 nt, Human
uguccccuuccuguucuucc

SEQ ID NO: 528256 - RNA, 32 nt, Human
uguccccuucuugcugccacaggaugaauaaa

SEQ ID NO: 528257 - RNA, 32 nt, Human
uguccccuucuuugcuaggaccccaguuaaaa

SEQ ID NO: 528258 - RNA, 32 nt, Human
uguccccuuuccacuuccccagcuucugcccc

SEQ ID NO: 528259 - RNA, 19 nt, Human
uguccccuuugggcuccuu

SEQ ID NO: 528260 - RNA, 20 nt, Human
uguccccuuuucuccacucc

SEQ ID NO: 528261 - RNA, 32 nt, Human
ugucccgaagaugcagucuucucuccaaugau

SEQ ID NO: 528262 - RNA, 32 nt, Human
ugucccgacacauaaucucugucucuuggacc

SEQ ID NO: 528263 - RNA, 32 nt, Human
ugucccgcccaggagccuugcaggcuggaggg

SEQ ID NO: 528264 - RNA, 32 nt, Human
ugucccgccgcgcuugccaaggguuggcugcg

SEQ ID NO: 528265 - RNA, 32 nt, Human
ugucccgcuagugccugcuaggugcauggcca

SEQ ID NO: 528266 - RNA, 32 nt, Human
ugucccgcugccacuuuccucacugauauugg

SEQ ID NO: 528267 - RNA, 32 nt, Human
ugucccggaggagguugggagguggaggccca

SEQ ID NO: 528268 - RNA, 32 nt, Human
ugucccggcagcaggagcuugguugguguuag

SEQ ID NO: 528269 - RNA, 32 nt, Human
ugucccggcggcauccacauguuuccggacac

SEQ ID NO: 528270 - RNA, 23 nt, Human
ugucccgggccccauugcuucca

SEQ ID NO: 528271 - RNA, 22 nt, Human
ugucccgggccccccaggcgga

SEQ ID NO: 528272 - RNA, 22 nt, Human
ugucccggggccguggugcccg

SEQ ID NO: 528273 - RNA, 32 nt, Human
ugucccuaaccagccacugcagcccuccagcu

SEQ ID NO: 528274 - RNA, 32 nt, Human
ugucccuacaaaaaguacaaaaauuagccggg

SEQ ID NO: 528275 - RNA, 32 nt, Human
ugucccuacauagcaauuuucuguggcacuga

SEQ ID NO: 528276 - RNA, 32 nt, Human
ugucccuacaucuucucuucugacuuuggcua

SEQ ID NO: 528277 - RNA, 32 nt, Human
ugucccuacccacccuggauuuucuggccccc

SEQ ID NO: 528278 - RNA, 22 nt, Human
ugucccuacuaaaaauacaaaa

SEQ ID NO: 528279 - RNA, 32 nt, Human
ugucccuacuaaaaauacaaaaauuaggugga

SEQ ID NO: 528280 - RNA, 21 nt, Human
ugucccuacuaaagauacaaa

SEQ ID NO: 528281 - RNA, 32 nt, Human
ugucccuacuaaagauacaaacaauuagccgg

SEQ ID NO: 528282 - RNA, 32 nt, Human
ugucccuacuucaagagcauguucacaggugg

SEQ ID NO: 528283 - RNA, 32 nt, Human
ugucccuagaaaacaaugcaaaaccuuugagg

SEQ ID NO: 528284 - RNA, 32 nt, Human
ugucccuaguaaaaaugcaaaaauuagcuggg

SEQ ID NO: 528285 - RNA, 32 nt, Human
ugucccuaguaguugggauuacaggcacaugc

SEQ ID NO: 528286 - RNA, 32 nt, Human
ugucccucacacuaaaacggcguagauggcaa

SEQ ID NO: 528287 - RNA, 25 nt, Human
ugucccuccaccccacccuccaccu

SEQ ID NO: 528288 - RNA, 32 nt, Human
ugucccuccccacacuccacauucauauguug

SEQ ID NO: 528289 - RNA, 32 nt, Human
ugucccucccccuugucuuucccuucaguacc

SEQ ID NO: 528290 - RNA, 31 nt, Human
ugucccucccucucugaaccugcuuccuccg

SEQ ID NO: 528291 - RNA, 20 nt, Human
ugucccuccuccaccccaca

SEQ ID NO: 528292 - RNA, 21 nt, Human
ugucccuccucccagaugaca

SEQ ID NO: 528293 - RNA, 32 nt, Human
ugucccuccuguucuuguccggcgcugcuuag

SEQ ID NO: 528294 - RNA, 32 nt, Human
ugucccucgauccagucuccgacuuccauuuc

SEQ ID NO: 528295 - RNA, 32 nt, Human
ugucccucggccagggcagauggaagcgggug

SEQ ID NO: 528296 - RNA, 32 nt, Human
ugucccucgggggcuuugggaaagcauggcac

SEQ ID NO: 528297 - RNA, 32 nt, Human
ugucccucgucuaauccaaggcucuucccagg

SEQ ID NO: 528298 - RNA, 32 nt, Human
ugucccucuacgacgggcugguauaucccagg

SEQ ID NO: 528299 - RNA, 32 nt, Human
ugucccucucacuaaaaaggaguguugugugu

SEQ ID NO: 528300 - RNA, 32 nt, Human
ugucccucucaggccuucuaggcacgugccug

SEQ ID NO: 528301 - RNA, 32 nt, Human
ugucccucugccacaguggcuuccuuccaucc

SEQ ID NO: 528302 - RNA, 22 nt, Human
ugucccucuguccccauguccu

SEQ ID NO: 528303 - RNA, 32 nt, Human
ugucccucugugagagaaggagcaggcagaga

SEQ ID NO: 528304 - RNA, 32 nt, Human
ugucccucuuccuucccaguugcccuuaagaa

SEQ ID NO: 528305 - RNA, 32 nt, Human
ugucccugagcaaacaacgcccgaaauacccu

SEQ ID NO: 528306 - RNA, 32 nt, Human
ugucccugaguaguuuugcugccauagguuaa

SEQ ID NO: 528307 - RNA, 32 nt, Human
ugucccugcugauugucaaagcagaaagaaau

SEQ ID NO: 528308 - RNA, 32 nt, Human
ugucccugcuggcugaggagccgcugcuggga

SEQ ID NO: 528309 - RNA, 32 nt, Human
ugucccugcuucuuuucugaccgggaaauaaa

SEQ ID NO: 528310 - RNA, 32 nt, Human
ugucccuggaauugagaaucuggaccuuauuu

SEQ ID NO: 528311 - RNA, 32 nt, Human
ugucccuggacacagcucuucauuccauugac

SEQ ID NO: 528312 - RNA, 20 nt, Human
ugucccuggagaguagccug

SEQ ID NO: 528313 - RNA, 21 nt, Human
ugucccuggcaugugccuuca

SEQ ID NO: 528314 - RNA, 18 nt, Human
ugucccuggcccaucuca

SEQ ID NO: 528315 - RNA, 32 nt, Human
ugucccuggccugccuugauuucagccacacc

SEQ ID NO: 528316 - RNA, 19 nt, Human
ugucccuggcugcgcuuuc

SEQ ID NO: 528317 - RNA, 32 nt, Human
ugucccugggagagggcagccgccggccuguc

SEQ ID NO: 528318 - RNA, 32 nt, Human
ugucccugggcaauggaaugucucgguauaaa

SEQ ID NO: 528319 - RNA, 32 nt, Human
ugucccugggccucugcccuugcugacuacuu

SEQ ID NO: 528320 - RNA, 32 nt, Human
ugucccuggggcagacacuaaggcagguguug

SEQ ID NO: 528321 - RNA, 32 nt, Human
ugucccugucgcgugcuugggcauuuuauuuu

SEQ ID NO: 528322 - RNA, 32 nt, Human
ugucccugucuagggcagcccagggcccccac

SEQ ID NO: 528323 - RNA, 32 nt, Human
ugucccugucucccugcccauuuccuaugcau

SEQ ID NO: 528324 - RNA, 32 nt, Human
ugucccuguggacucccaaacucuacuccaga

SEQ ID NO: 528325 - RNA, 32 nt, Human
ugucccuguggucccagcuacucaggaggcug

SEQ ID NO: 528326 - RNA, 32 nt, Human
ugucccugugugacacggcucggaugaccccc

SEQ ID NO: 528327 - RNA, 32 nt, Human
ugucccuuagccaaccugcugggcucaccagu

SEQ ID NO: 528328 - RNA, 25 nt, Human
ugucccuucacugcacuuucuuccu

SEQ ID NO: 528329 - RNA, 32 nt, Human
ugucccuucaggcucacaugcacaggaaugcu

SEQ ID NO: 528330 - RNA, 32 nt, Human
ugucccuucauacccuagucccuggacagcug

SEQ ID NO: 528331 - RNA, 32 nt, Human
ugucccuuccauuucugagaacaagucagccc

SEQ ID NO: 528332 - RNA, 32 nt, Human
ugucccuucccagccuuugaggaguuagggaa

SEQ ID NO: 528333 - RNA, 32 nt, Human
ugucccuucugccccaggggcuugccuggcuu

SEQ ID NO: 528334 - RNA, 32 nt, Human
ugucccuucuguccucaggggccuucagaagc

SEQ ID NO: 528335 - RNA, 23 nt, Human
ugucccuucuucacaccuacuca

SEQ ID NO: 528336 - RNA, 32 nt, Human
ugucccuugaugggugcccuccaggaaccaag

SEQ ID NO: 528337 - RNA, 21 nt, Human
ugucccuugcacccccugccu

SEQ ID NO: 528338 - RNA, 32 nt, Human
ugucccuugcucagaagaaagaucggguaacu

SEQ ID NO: 528339 - RNA, 32 nt, Human
ugucccuugguauccaugggguauugguuccu

SEQ ID NO: 528340 - RNA, 32 nt, Human
ugucccuugucacuuuguugcaagcuagaaau

SEQ ID NO: 528341 - RNA, 21 nt, Human
ugucccuuuuagagacaccuu

SEQ ID NO: 528342 - RNA, 23 nt, Human
ugucccuuuucccacccuccacc

SEQ ID NO: 528343 - RNA, 21 nt, Human
uguccgagccuguggucaagg

SEQ ID NO: 528344 - RNA, 32 nt, Human
uguccgaggaguugggggaccaucccagcagg

SEQ ID NO: 528345 - RNA, 32 nt, Human
uguccgaggcaccacuguuucuugccuggagu

SEQ ID NO: 528346 - RNA, 32 nt, Human
uguccgagggccaccaggccgccgggggccug

SEQ ID NO: 528347 - RNA, 32 nt, Human
uguccgagugugccacacgagaaccugaaggg

SEQ ID NO: 528348 - RNA, 32 nt, Human
uguccgaguuugcagggugcugagcuguaugg

SEQ ID NO: 528349 - RNA, 32 nt, Human
uguccgcagccuccaggagccccacacagggc

SEQ ID NO: 528350 - RNA, 32 nt, Human
uguccgcauacaggcguacacaugcacgcuug

SEQ ID NO: 528351 - RNA, 23 nt, Human
uguccgccaggcuggagugcagu

SEQ ID NO: 528352 - RNA, 24 nt, Human
uguccgccaggcuggagugcagug

SEQ ID NO: 528353 - RNA, 32 nt, Human
uguccgcccaggcugggugcagucacggcuca

SEQ ID NO: 528354 - RNA, 32 nt, Human
uguccgcccugccugccugccuguguggucug

SEQ ID NO: 528355 - RNA, 32 nt, Human
uguccgcccuucacaccuccagccucacguuc

SEQ ID NO: 528356 - RNA, 32 nt, Human
uguccgccgcugcagccgccuccuccuccagg

SEQ ID NO: 528357 - RNA, 32 nt, Human
uguccgccggccccagcacccaggggacgcgc

SEQ ID NO: 528358 - RNA, 32 nt, Human
uguccgccugcagggcauuccagaaagaugag

SEQ ID NO: 528359 - RNA, 32 nt, Human
uguccgcggcagcugucuuuuugcuacuauaa

SEQ ID NO: 528360 - RNA, 32 nt, Human
uguccgcggcugcugcucagcgcccuggcaca

SEQ ID NO: 528361 - RNA, 32 nt, Human
uguccgcuccccucugggucgaggccacagcu

SEQ ID NO: 528362 - RNA, 32 nt, Human
uguccggaagacauggauugucuggaagaugu

SEQ ID NO: 528363 - RNA, 32 nt, Human
uguccggagccagcucacugucuuccacacug

SEQ ID NO: 528364 - RNA, 32 nt, Human
uguccggcguaaggacgacaccgucagcuguc

SEQ ID NO: 528365 - RNA, 20 nt, Human
uguccggcucucugguggcc

SEQ ID NO: 528366 - RNA, 32 nt, Human
uguccggcugucauuucuccaccuagagccuu

SEQ ID NO: 528367 - RNA, 32 nt, Human
uguccggggucccugcacccacggucacuugg

SEQ ID NO: 528368 - RNA, 24 nt, Human
uguccgggguucggccauguccuc

SEQ ID NO: 528369 - RNA, 32 nt, Human
uguccgucaguguguggauguauguuuacagu

SEQ ID NO: 528370 - RNA, 32 nt, Human
uguccgucaguuauuaguggauggagauuccc

SEQ ID NO: 528371 - RNA, 32 nt, Human
uguccguccagagccggcauccuugccugucu

SEQ ID NO: 528372 - RNA, 32 nt, Human
uguccgucugcagcugcgugacugucugucuc

SEQ ID NO: 528373 - RNA, 32 nt, Human
uguccgucugggcacugguccaugaccuguug

SEQ ID NO: 528374 - RNA, 32 nt, Human
uguccgugcuugcuggugccucuuuucaguag

SEQ ID NO: 528375 - RNA, 32 nt, Human
uguccguggcggcugguguuggcuggcauugg

SEQ ID NO: 528376 - RNA, 32 nt, Human
uguccguguggaggggacauagacacugcaug

SEQ ID NO: 528377 - RNA, 21 nt, Human
uguccguucccacccaccccc

SEQ ID NO: 528378 - RNA, 32 nt, Human
uguccuaaccaccgggcgcaccaucuuuccuu

SEQ ID NO: 528379 - RNA, 32 nt, Human
uguccuaagagcugcacccuggagauggggug

SEQ ID NO: 528380 - RNA, 32 nt, Human
uguccuaaggaaccuuccuuccugcuugaguu

SEQ ID NO: 528381 - RNA, 32 nt, Human
uguccuaaugugcugcccagaaaccucaacug

SEQ ID NO: 528382 - RNA, 32 nt, Human
uguccuaccacuuugaaugguuuucuaauauc

SEQ ID NO: 528383 - RNA, 32 nt, Human
uguccuacuuuccucauugccuaggcaaccau

SEQ ID NO: 528384 - RNA, 32 nt, Human
uguccuagaagagggaagaggaaggaaggugg

SEQ ID NO: 528385 - RNA, 32 nt, Human
uguccuagagaggcccagcagagcagcucaga

SEQ ID NO: 528386 - RNA, 32 nt, Human
uguccuagaugagaacccugaagaaugcagac

SEQ ID NO: 528387 - RNA, 32 nt, Human
uguccuagcucaggucugggugccauucuuua

SEQ ID NO: 528388 - RNA, 32 nt, Human
uguccuagucagaugaaggaggcugcacuaca

SEQ ID NO: 528389 - RNA, 32 nt, Human
uguccuaguccuagugcugaaugaucccauug

SEQ ID NO: 528390 - RNA, 32 nt, Human
uguccuaucaaauuaguaaaccaaaggaaaag

SEQ ID NO: 528391 - RNA, 32 nt, Human
uguccuaugucccagggauaccgcucaaagca

SEQ ID NO: 528392 - RNA, 32 nt, Human
uguccuauuucuaucuccacuuugugccugga

SEQ ID NO: 528393 - RNA, 32 nt, Human
uguccucaacaacagcaaagcuucuugggaga

SEQ ID NO: 528394 - RNA, 22 nt, Human
uguccucaaucucucugucucc

SEQ ID NO: 528395 - RNA, 32 nt, Human
uguccucacccaguuccugcagugucucugac

SEQ ID NO: 528396 - RNA, 32 nt, Human
uguccucagacccaaguaggagagggcugcug

SEQ ID NO: 528397 - RNA, 32 nt, Human
uguccucagaccccugaggugcaggauguggg

SEQ ID NO: 528398 - RNA, 32 nt, Human
uguccucagagcagccucgccugcugacccca

SEQ ID NO: 528399 - RNA, 32 nt, Human
uguccucagaggaggaggaggaggaggcagcu

SEQ ID NO: 528400 - RNA, 32 nt, Human
uguccucagcaacacuccacagcagaaagggg

SEQ ID NO: 528401 - RNA, 32 nt, Human
uguccucagcauccucccgucccaacccaacc

SEQ ID NO: 528402 - RNA, 21 nt, Human
uguccucagcucaagaauccu

SEQ ID NO: 528403 - RNA, 20 nt, Human
uguccucagcucccagggcu

SEQ ID NO: 528404 - RNA, 21 nt, Human
uguccucagcucccaucuccu

SEQ ID NO: 528405 - RNA, 32 nt, Human
uguccucagcugguugguagaguuugagcuuc

SEQ ID NO: 528406 - RNA, 32 nt, Human
uguccucagcuugucuggaggaggccugcauc

SEQ ID NO: 528407 - RNA, 32 nt, Human
uguccucaggauagggaagagcagggggaugc

SEQ ID NO: 528408 - RNA, 32 nt, Human
uguccucagggugggcagagccacuaaacuug

SEQ ID NO: 528409 - RNA, 32 nt, Human
uguccucaggguggggcagguuggcacuuccc

SEQ ID NO: 528410 - RNA, 32 nt, Human
uguccucaguggaaggugaugggggccggugc

SEQ ID NO: 528411 - RNA, 32 nt, Human
uguccucaucacccucuuuugcugccugucaa

SEQ ID NO: 528412 - RNA, 32 nt, Human
uguccucaucaccugugucuuugcugcuuuug

SEQ ID NO: 528413 - RNA, 32 nt, Human
uguccucaucccugcccagcaggcugcagaac

SEQ ID NO: 528414 - RNA, 32 nt, Human
uguccucaucucugccugccuucccucuugcc

SEQ ID NO: 528415 - RNA, 32 nt, Human
uguccucaugugguggaaggggugaggggucu

SEQ ID NO: 528416 - RNA, 32 nt, Human
uguccuccaaagugcugggauuacaggcauga

SEQ ID NO: 528417 - RNA, 23 nt, Human
uguccuccacuccagcuguuucc

SEQ ID NO: 528418 - RNA, 22 nt, Human
uguccuccaggcaccugggucc

SEQ ID NO: 528419 - RNA, 23 nt, Human
uguccuccaggcuggagugcaau

SEQ ID NO: 528420 - RNA, 24 nt, Human
uguccuccaggcuggagugcaaug

SEQ ID NO: 528421 - RNA, 32 nt, Human
uguccuccaggcuggggcagguucuuaguuug

SEQ ID NO: 528422 - RNA, 32 nt, Human
uguccucccaacugaaaacaacagugacaugu

SEQ ID NO: 528423 - RNA, 26 nt, Human
uguccuccccacaaacacuguguccu

SEQ ID NO: 528424 - RNA, 32 nt, Human
uguccuccccuccccucccuuccucuccuccc

SEQ ID NO: 528425 - RNA, 32 nt, Human
uguccuccccugauaggauucucccuuugaag

SEQ ID NO: 528426 - RNA, 24 nt, Human
uguccucccgcuccucgcuguccu

SEQ ID NO: 528427 - RNA, 32 nt, Human
uguccucccuccaccuaccacucacaugacac

SEQ ID NO: 528428 - RNA, 22 nt, Human
uguccucccugcccugcagucc

SEQ ID NO: 528429 - RNA, 32 nt, Human
uguccucccugccuuccaccuuggagaggagg

SEQ ID NO: 528430 - RNA, 21 nt, Human
uguccucccuucccugugccu

SEQ ID NO: 528431 - RNA, 32 nt, Human
uguccucccuuguggcuuccuuagcuccuguu

SEQ ID NO: 528432 - RNA, 32 nt, Human
uguccuccgcacagccggucagaacuguguga

SEQ ID NO: 528433 - RNA, 32 nt, Human
uguccuccggaccuacccaggucuccaccauc

SEQ ID NO: 528434 - RNA, 32 nt, Human
uguccuccgggaccccagcccucaggauuccu

SEQ ID NO: 528435 - RNA, 28 nt, Human
uguccuccucacagagagcucagagaug

SEQ ID NO: 528436 - RNA, 32 nt, Human
uguccuccucaccaagggccacccucaccaga

SEQ ID NO: 528437 - RNA, 32 nt, Human
uguccuccuccacuucccaugccucuauguua

SEQ ID NO: 528438 - RNA, 20 nt, Human
uguccuccuccccauguccu

SEQ ID NO: 528439 - RNA, 32 nt, Human
uguccuccuccccuggacaaucuccucuugga

SEQ ID NO: 528440 - RNA, 32 nt, Human
uguccuccugcucugcuuccucagggcccagc

SEQ ID NO: 528441 - RNA, 32 nt, Human
uguccuccugggagcagggguugggggagggg

SEQ ID NO: 528442 - RNA, 32 nt, Human
uguccuccuuggagguccccaaagaaggaguc

SEQ ID NO: 528443 - RNA, 32 nt, Human
uguccucgacccaccuguccagcuucaucccu

SEQ ID NO: 528444 - RNA, 32 nt, Human
uguccucgcccuguauuucuccaucuccaguu

SEQ ID NO: 528445 - RNA, 32 nt, Human
uguccucgcucuaccucugccucuccggaggu

SEQ ID NO: 528446 - RNA, 32 nt, Human
uguccucggaucacagucucuucucacuacag

SEQ ID NO: 528447 - RNA, 32 nt, Human
uguccucggugcauccggcugcagagggaaau

SEQ ID NO: 528448 - RNA, 32 nt, Human
uguccucggugccaccaccccugugguacaag

SEQ ID NO: 528449 - RNA, 32 nt, Human
uguccucguccuggccugcagcucuucccagc

SEQ ID NO: 528450 - RNA, 32 nt, Human
uguccucuacuuccaugaggccuucgagaggc

SEQ ID NO: 528451 - RNA, 32 nt, Human
uguccucucagccuguggccuccacauccccg

SEQ ID NO: 528452 - RNA, 32 nt, Human
uguccucucaucccaguccugauggccgcuug

SEQ ID NO: 528453 - RNA, 32 nt, Human
uguccucuccccuccagccuuuggccuuggcu

SEQ ID NO: 528454 - RNA, 32 nt, Human
uguccucucccucgacccucccccuccuuguc

SEQ ID NO: 528455 - RNA, 32 nt, Human
uguccucucgacuuccuuccuuagcuucaugu

SEQ ID NO: 528456 - RNA, 32 nt, Human
uguccucucuaggaagggguaggggaggggcg

SEQ ID NO: 528457 - RNA, 32 nt, Human
uguccucugacccuuuggcucauccuagauug

SEQ ID NO: 528458 - RNA, 32 nt, Human
uguccucugauucccaccccuacccaccaaaa

SEQ ID NO: 528459 - RNA, 32 nt, Human
uguccucugcaacccaaacguccaggaggauc

SEQ ID NO: 528460 - RNA, 32 nt, Human
uguccucugcaagcccccugcuguggcuuggu

SEQ ID NO: 528461 - RNA, 21 nt, Human
uguccucugcaccaaugacac

SEQ ID NO: 528462 - RNA, 32 nt, Human
uguccucugcagcuuuugauauguuauucuca

SEQ ID NO: 528463 - RNA, 32 nt, Human
uguccucugccaccccugcccacuguccaggg

SEQ ID NO: 528464 - RNA, 32 nt, Human
uguccucugccucccucugcuguucuucuaga

SEQ ID NO: 528465 - RNA, 32 nt, Human
uguccucugccugggcucuggaagaggccuuc

SEQ ID NO: 528466 - RNA, 32 nt, Human
uguccucugcugucuccucugguccugagaug

SEQ ID NO: 528467 - RNA, 24 nt, Human
uguccucuggaucugcugcguccu

SEQ ID NO: 528468 - RNA, 32 nt, Human
uguccucugggagcuuuccuuguuugguuuuc

SEQ ID NO: 528469 - RNA, 32 nt, Human
uguccucugugcaguggaaggaggaggggcga

SEQ ID NO: 528470 - RNA, 32 nt, Human
uguccucugugccucuuuccuugucugaggug

SEQ ID NO: 528471 - RNA, 32 nt, Human
uguccucuucuccccucucucagauuggccug

SEQ ID NO: 528472 - RNA, 32 nt, Human
uguccucuugggaacagcccucagccagcagu

SEQ ID NO: 528473 - RNA, 32 nt, Human
uguccucuuucagcuccugaccaguugcaguc

SEQ ID NO: 528474 - RNA, 32 nt, Human
uguccucuuucagcuccugauccguugcaguc

SEQ ID NO: 528475 - RNA, 32 nt, Human
uguccugaaacccagaagugauggagagaaac

SEQ ID NO: 528476 - RNA, 32 nt, Human
uguccugaaagccacagacaauauggucccaa

SEQ ID NO: 528477 - RNA, 32 nt, Human
uguccugaaaggaagacauaaguguugugauu

SEQ ID NO: 528478 - RNA, 32 nt, Human
uguccugaagucaacccaaaaaucaacacuac

SEQ ID NO: 528479 - RNA, 32 nt, Human
uguccugacuucauaggugccaccuugugguu

SEQ ID NO: 528480 - RNA, 32 nt, Human
uguccugagauggacgucagguccagccugcc

SEQ ID NO: 528481 - RNA, 32 nt, Human
uguccugagccugcuugucaccugggccucac

SEQ ID NO: 528482 - RNA, 32 nt, Human
uguccugaggggauacuguggagcagcccagu

SEQ ID NO: 528483 - RNA, 32 nt, Human
uguccugaguaguugcucccagcugggaaagg

SEQ ID NO: 528484 - RNA, 32 nt, Human
uguccugaguguuuacagcaggccauguacua

SEQ ID NO: 528485 - RNA, 32 nt, Human
uguccugaugucugagacacuguccauugugc

SEQ ID NO: 528486 - RNA, 32 nt, Human
uguccugcaguuggaggccaccagagguaucu

SEQ ID NO: 528487 - RNA, 24 nt, Human
uguccugcauccagucuguguccu

SEQ ID NO: 528488 - RNA, 32 nt, Human
uguccugccacaucucccucuccgagagggua

SEQ ID NO: 528489 - RNA, 32 nt, Human
uguccugccaggcaccguggucucauccgccu

SEQ ID NO: 528490 - RNA, 21 nt, Human
uguccugccauccuguguccu

SEQ ID NO: 528491 - RNA, 32 nt, Human
uguccugcccauguccuccuugguggacguuu

SEQ ID NO: 528492 - RNA, 24 nt, Human
uguccugccccaccacaaaaggaa

SEQ ID NO: 528493 - RNA, 32 nt, Human
uguccugcccccaaggaggcagccuggaccac

SEQ ID NO: 528494 - RNA, 32 nt, Human
uguccugccuccaugcugucccuucucagcac

SEQ ID NO: 528495 - RNA, 32 nt, Human
uguccugccuugaugaagccugugccaccugc

SEQ ID NO: 528496 - RNA, 32 nt, Human
uguccugcucagugccaaggugcuacucuugc

SEQ ID NO: 528497 - RNA, 32 nt, Human
uguccugcuggauccuuccugcaguggcucgg

SEQ ID NO: 528498 - RNA, 32 nt, Human
uguccugcugggacaacuaagaagagagaaug

SEQ ID NO: 528499 - RNA, 32 nt, Human
uguccugcuguuacuccuucuuugguaguuga

SEQ ID NO: 528500 - RNA, 22 nt, Human
uguccuggacaacauggugaaa

SEQ ID NO: 528501 - RNA, 32 nt, Human
uguccuggaggcacugggaagccuagagaagg

SEQ ID NO: 528502 - RNA, 32 nt, Human
uguccuggaugcugggauacaagaauagcaga

SEQ ID NO: 528503 - RNA, 32 nt, Human
uguccuggccagagaagacugguaggggccga

SEQ ID NO: 528504 - RNA, 32 nt, Human
uguccuggccugccacugacccugucuguauu

SEQ ID NO: 528505 - RNA, 32 nt, Human
uguccuggcgcacaccuguaaucccagcuacu

SEQ ID NO: 528506 - RNA, 32 nt, Human
uguccuggcuggaccagccacugugggaccaa

SEQ ID NO: 528507 - RNA, 32 nt, Human
uguccugggauccucagaagccugacuguccu

SEQ ID NO: 528508 - RNA, 32 nt, Human
uguccugggaucuaguuaucuuggcccugcac

SEQ ID NO: 528509 - RNA, 32 nt, Human
uguccugggccaaggagcagggagacaggagg

SEQ ID NO: 528510 - RNA, 32 nt, Human
uguccuggggagaaggaaggcugagccucucc

SEQ ID NO: 528511 - RNA, 32 nt, Human
uguccuggguguuugcagcaggccauguacua

SEQ ID NO: 528512 - RNA, 32 nt, Human
uguccuggguucccauggacucagggauuugu

SEQ ID NO: 528513 - RNA, 32 nt, Human
uguccugguaccugggcccagcucgccaggga

SEQ ID NO: 528514 - RNA, 32 nt, Human
uguccuggucaguuuucacagaggcgguugua

SEQ ID NO: 528515 - RNA, 32 nt, Human
uguccugguguucauuucaaggccaguguuca

SEQ ID NO: 528516 - RNA, 32 nt, Human
uguccuguaaaugcagaacaugccauguaauu

SEQ ID NO: 528517 - RNA, 32 nt, Human
uguccuguauagcaaccuauuuugacugcuuc

SEQ ID NO: 528518 - RNA, 32 nt, Human
uguccugucaucuagccaucugauaucuuccu

SEQ ID NO: 528519 - RNA, 32 nt, Human
uguccugucccugccagcaccuggagcaccaa

SEQ ID NO: 528520 - RNA, 32 nt, Human
uguccuguccugacuucaucucuccuucugcc

SEQ ID NO: 528521 - RNA, 32 nt, Human
uguccugugagugugacccugacucauccaga

SEQ ID NO: 528522 - RNA, 32 nt, Human
uguccuguggagcugccgccauggccccgcgg

SEQ ID NO: 528523 - RNA, 32 nt, Human
uguccugugugucuguccuccuugugaucagu

SEQ ID NO: 528524 - RNA, 32 nt, Human
uguccuguguuuuguaaagaugaggguuauuu

SEQ ID NO: 528525 - RNA, 32 nt, Human
uguccuguugguaggagguggggccaagagug

SEQ ID NO: 528526 - RNA, 32 nt, Human
uguccuguuguggggcuggagcugcucccacc

SEQ ID NO: 528527 - RNA, 32 nt, Human
uguccuguuucucacccagcaccuggggagau

SEQ ID NO: 528528 - RNA, 32 nt, Human
uguccuguuuuuaaaauauacaauuauucuua

SEQ ID NO: 528529 - RNA, 32 nt, Human
uguccuuaaauacuuuaugccucugaacuuuc

SEQ ID NO: 528530 - RNA, 32 nt, Human
uguccuuacccuccaagccucaguuuaccuuu

SEQ ID NO: 528531 - RNA, 32 nt, Human
uguccuuagaaccaccuuccccuacuucaucu

SEQ ID NO: 528532 - RNA, 32 nt, Human
uguccuuagaaggagaaagacagagacacauc

SEQ ID NO: 528533 - RNA, 32 nt, Human
uguccuuagacuccugagguuuuuacacuugc

SEQ ID NO: 528534 - RNA, 32 nt, Human
uguccuuagacuccuucuccccaaucacgaga

SEQ ID NO: 528535 - RNA, 32 nt, Human
uguccuuauaagaagaggagauuaggucacag

SEQ ID NO: 528536 - RNA, 32 nt, Human
uguccuuaugugaagcuuugaagguguacagc

SEQ ID NO: 528537 - RNA, 32 nt, Human
uguccuucagccccuggaaggugcuccaggau

SEQ ID NO: 528538 - RNA, 32 nt, Human
uguccuucagguagcugagacuacaggcgugc

SEQ ID NO: 528539 - RNA, 32 nt, Human
uguccuucaucuuucccuuucccuucaaaucu

SEQ ID NO: 528540 - RNA, 32 nt, Human
uguccuucauuucuccuucauuucucagucac

SEQ ID NO: 528541 - RNA, 32 nt, Human
uguccuuccaagagacagaagaggagacacag

SEQ ID NO: 528542 - RNA, 32 nt, Human
uguccuuccaauauaugcauuacagaugaaaa

SEQ ID NO: 528543 - RNA, 32 nt, Human
uguccuucccgcagcuggcccugugguguucc

SEQ ID NO: 528544 - RNA, 32 nt, Human
uguccuuccgggcuagauuucuucuuucucuu

SEQ ID NO: 528545 - RNA, 32 nt, Human
uguccuuccugcucuuucuucucugcccaggc

SEQ ID NO: 528546 - RNA, 32 nt, Human
uguccuuccuggcccuugcauggaugcaguug

SEQ ID NO: 528547 - RNA, 32 nt, Human
uguccuuccuucaguguuccugggugaggagu

SEQ ID NO: 528548 - RNA, 32 nt, Human
uguccuucuaagcuucugaugcacugaauuau

SEQ ID NO: 528549 - RNA, 32 nt, Human
uguccuucuccucuuuguccuccugcuuuccg

SEQ ID NO: 528550 - RNA, 32 nt, Human
uguccuucugccaagguggauuuguuagucuc

SEQ ID NO: 528551 - RNA, 32 nt, Human
uguccuugaacccaccuuccuccaucccugcc

SEQ ID NO: 528552 - RNA, 32 nt, Human
uguccuugacucugugcugcugccuucugcag

SEQ ID NO: 528553 - RNA, 32 nt, Human
uguccuugagaaccuuguccucccugcugauu

SEQ ID NO: 528554 - RNA, 32 nt, Human
uguccuugcacuccuaucuggagauaucacag

SEQ ID NO: 528555 - RNA, 32 nt, Human
uguccuugcauuggugcgccucaggccaggcu

SEQ ID NO: 528556 - RNA, 32 nt, Human
uguccuugcccagcgccaccaggcuggaggcg

SEQ ID NO: 528557 - RNA, 32 nt, Human
uguccuugcucaugccugccucuuucacuugg

SEQ ID NO: 528558 - RNA, 21 nt, Human
uguccuugcugcccuggcccu

SEQ ID NO: 528559 - RNA, 32 nt, Human
uguccuugcuugugccugccucuuucacuugg

SEQ ID NO: 528560 - RNA, 32 nt, Human
uguccuuggcagcagggaggaagcaggagugc

SEQ ID NO: 528561 - RNA, 32 nt, Human
uguccuugggcgcugcuuggagauacugggcu

SEQ ID NO: 528562 - RNA, 32 nt, Human
uguccuuggggaggggucagcucuggccccaa

SEQ ID NO: 528563 - RNA, 32 nt, Human
uguccuuggggcggggugguugcaguaguguc

SEQ ID NO: 528564 - RNA, 32 nt, Human
uguccuuggucacugaggccauuggaucuucc

SEQ ID NO: 528565 - RNA, 18 nt, Human
uguccuuggugccuggag

SEQ ID NO: 528566 - RNA, 32 nt, Human
uguccuuguguaugguacuaaauguguccugu

SEQ ID NO: 528567 - RNA, 32 nt, Human
uguccuuguucucauuaauucagcuaaaggug

SEQ ID NO: 528568 - RNA, 32 nt, Human
uguccuuucauuucucuauccaaguagcaguc

SEQ ID NO: 528569 - RNA, 32 nt, Human
uguccuuucccccuucccagacaacaggagaa

SEQ ID NO: 528570 - RNA, 32 nt, Human
uguccuuuccccucagcugucuuugcuucaca

SEQ ID NO: 528571 - RNA, 32 nt, Human
uguccuuucuuucccuuccuuacuaauaaugg

SEQ ID NO: 528572 - RNA, 22 nt, Human
uguccuuugcccccugugcccu

SEQ ID NO: 528573 - RNA, 32 nt, Human
uguccuuugggggccccaggagguagagauuc

SEQ ID NO: 528574 - RNA, 32 nt, Human
uguccuuuuucaucccuucaucuugcugcugg

SEQ ID NO: 528575 - RNA, 32 nt, Human
ugucgaaagacaccugccugcuuugcgacucc

SEQ ID NO: 528576 - RNA, 32 nt, Human
ugucgaagcuaucugcucuguuaaauuaagca

SEQ ID NO: 528577 - RNA, 32 nt, Human
ugucgaauucaugggugugugugcacauguug

SEQ ID NO: 528578 - RNA, 32 nt, Human
ugucgagcauuugacauaagacagcgugaugu

SEQ ID NO: 528579 - RNA, 32 nt, Human
ugucgaggaagggaagaaagaaacagaaguca

SEQ ID NO: 528580 - RNA, 32 nt, Human
ugucgaggagcaaggcuugccagcaagucaga

SEQ ID NO: 528581 - RNA, 32 nt, Human
ugucgaggaugcacuguguggagaaaugcccu

SEQ ID NO: 528582 - RNA, 32 nt, Human
ugucgagguggccauguugccaggcaaauaug

SEQ ID NO: 528583 - RNA, 32 nt, Human
ugucgaugcccgccaggacuguuuucaugcug

SEQ ID NO: 528584 - RNA, 32 nt, Human
ugucgcacucagccaacauuccuguuuuugaa

SEQ ID NO: 528585 - RNA, 31 nt, Human
ugucgcacugccucccacccugugucugcuu

SEQ ID NO: 528586 - RNA, 32 nt, Human
ugucgcacugccucccacccugugucugcuuc

SEQ ID NO: 528587 - RNA, 32 nt, Human
ugucgcagagggcauugugacauaucacuggu

SEQ ID NO: 528588 - RNA, 32 nt, Human
ugucgcagccuuccucacucuguuccucggcc

SEQ ID NO: 528589 - RNA, 32 nt, Human
ugucgcaggcggggcuccugggaggcuggggu

SEQ ID NO: 528590 - RNA, 32 nt, Human
ugucgcaggggcuccagcgauaccucagccuu

SEQ ID NO: 528591 - RNA, 22 nt, Human
ugucgccaagccagagugcagu

SEQ ID NO: 528592 - RNA, 23 nt, Human
ugucgccaagccagagugcagug

SEQ ID NO: 528593 - RNA, 23 nt, Human
ugucgccaaggcuggagugcagu

SEQ ID NO: 528594 - RNA, 24 nt, Human
ugucgccaaggcuggagugcagug

SEQ ID NO: 528595 - RNA, 32 nt, Human
ugucgccaaguuggagcuugcagugagccgag

SEQ ID NO: 528596 - RNA, 22 nt, Human
ugucgccaaguuggagugcaau

SEQ ID NO: 528597 - RNA, 23 nt, Human
ugucgccaaguuggagugcaaug

SEQ ID NO: 528598 - RNA, 32 nt, Human
ugucgccacagcugcccagcuggguccgcugc

SEQ ID NO: 528599 - RNA, 32 nt, Human
ugucgccaccuggacagcgugaccucaggggu

SEQ ID NO: 528600 - RNA, 22 nt, Human
ugucgccagacuggagugcagu

SEQ ID NO: 528601 - RNA, 23 nt, Human
ugucgccagacuggagugcagug

SEQ ID NO: 528602 - RNA, 23 nt, Human
ugucgccaggcuagagugcggug

SEQ ID NO: 528603 - RNA, 22 nt, Human
ugucgccaggcugaagugcagu

SEQ ID NO: 528604 - RNA, 23 nt, Human
ugucgccaggcugaagugcagug

SEQ ID NO: 528605 - RNA, 22 nt, Human
ugucgccaggcuggaaugcagu

SEQ ID NO: 528606 - RNA, 23 nt, Human
ugucgccaggcuggaaugcagua

SEQ ID NO: 528607 - RNA, 23 nt, Human
ugucgccaggcuggaaugcagug

SEQ ID NO: 528608 - RNA, 22 nt, Human
ugucgccaggcuggagugcaau

SEQ ID NO: 528609 - RNA, 23 nt, Human
ugucgccaggcuggagugcaaug

SEQ ID NO: 528610 - RNA, 22 nt, Human
ugucgccaggcuggagugcagu

SEQ ID NO: 528611 - RNA, 23 nt, Human
ugucgccaggcuggagugcagug

SEQ ID NO: 528612 - RNA, 22 nt, Human
ugucgccaggcuggaguguagu

SEQ ID NO: 528613 - RNA, 23 nt, Human
ugucgccaggcuggaguguagug

SEQ ID NO: 528614 - RNA, 22 nt, Human
ugucgccagguuggagugcagu

SEQ ID NO: 528615 - RNA, 23 nt, Human
ugucgccagguuggagugcagug

SEQ ID NO: 528616 - RNA, 23 nt, Human
ugucgcccaacuagaguguagug

SEQ ID NO: 528617 - RNA, 23 nt, Human
ugucgcccaagcuagagugcagu

SEQ ID NO: 528618 - RNA, 24 nt, Human
ugucgcccaagcuagagugcagug

SEQ ID NO: 528619 - RNA, 23 nt, Human
ugucgcccaagcuggagcgcaau

SEQ ID NO: 528620 - RNA, 24 nt, Human
ugucgcccaagcuggagcgcaaug

SEQ ID NO: 528621 - RNA, 23 nt, Human
ugucgcccaagcuggaguacagu

SEQ ID NO: 528622 - RNA, 24 nt, Human
ugucgcccaagcuggaguacagug

SEQ ID NO: 528623 - RNA, 23 nt, Human
ugucgcccaagcuggagugcagu

SEQ ID NO: 528624 - RNA, 24 nt, Human
ugucgcccaagcuggagugcagug

SEQ ID NO: 528625 - RNA, 32 nt, Human
ugucgcccacccaggcuggaguacaguggcac

SEQ ID NO: 528626 - RNA, 23 nt, Human
ugucgcccagacuagaaugcagu

SEQ ID NO: 528627 - RNA, 24 nt, Human
ugucgcccagacuagaaugcagug

SEQ ID NO: 528628 - RNA, 23 nt, Human
ugucgcccagacuagagugcaau

SEQ ID NO: 528629 - RNA, 24 nt, Human
ugucgcccagacuagagugcaaug

SEQ ID NO: 528630 - RNA, 23 nt, Human
ugucgcccagacuggaguccagu

SEQ ID NO: 528631 - RNA, 20 nt, Human
ugucgcccagacuggagugc

SEQ ID NO: 528632 - RNA, 23 nt, Human
ugucgcccagacuggagugcagu

SEQ ID NO: 528633 - RNA, 24 nt, Human
ugucgcccagacuggagugcagug

SEQ ID NO: 528634 - RNA, 24 nt, Human
ugucgcccagacuggagugcugug

SEQ ID NO: 528635 - RNA, 23 nt, Human
ugucgcccagacuguaguacagu

SEQ ID NO: 528636 - RNA, 24 nt, Human
ugucgcccagacuguaguacagug

SEQ ID NO: 528637 - RNA, 32 nt, Human
ugucgcccagaggccgagcgccgcugugacgu

SEQ ID NO: 528638 - RNA, 23 nt, Human
ugucgcccagccuggagugcagu

SEQ ID NO: 528639 - RNA, 24 nt, Human
ugucgcccagccuggagugcagug

SEQ ID NO: 528640 - RNA, 23 nt, Human
ugucgcccaggauggagugcagu

SEQ ID NO: 528641 - RNA, 24 nt, Human
ugucgcccaggauggagugcagug

SEQ ID NO: 528642 - RNA, 24 nt, Human
ugucgcccaggcuagaguauagug

SEQ ID NO: 528643 - RNA, 26 nt, Human
ugucgcccaggcuagaguauaguggu

SEQ ID NO: 528644 - RNA, 19 nt, Human
ugucgcccaggcuagagug

SEQ ID NO: 528645 - RNA, 23 nt, Human
ugucgcccaggcuagagugcagu

SEQ ID NO: 528646 - RNA, 24 nt, Human
ugucgcccaggcuagagugcagug

SEQ ID NO: 528647 - RNA, 32 nt, Human
ugucgcccaggcugcaaccucgaccucccggg

SEQ ID NO: 528648 - RNA, 23 nt, Human
ugucgcccaggcugcagugcagu

SEQ ID NO: 528649 - RNA, 24 nt, Human
ugucgcccaggcugcagugcagug

SEQ ID NO: 528650 - RNA, 20 nt, Human
ugucgcccaggcuggaaugc

SEQ ID NO: 528651 - RNA, 23 nt, Human
ugucgcccaggcuggaaugcagu

SEQ ID NO: 528652 - RNA, 24 nt, Human
ugucgcccaggcuggaaugcagug

SEQ ID NO: 528653 - RNA, 23 nt, Human
ugucgcccaggcuggaaugcugu

SEQ ID NO: 528654 - RNA, 23 nt, Human
ugucgcccaggcuggacugcagu

SEQ ID NO: 528655 - RNA, 24 nt, Human
ugucgcccaggcuggacugcagug

SEQ ID NO: 528656 - RNA, 23 nt, Human
ugucgcccaggcuggagagcagu

SEQ ID NO: 528657 - RNA, 24 nt, Human
ugucgcccaggcuggagagcagug

SEQ ID NO: 528658 - RNA, 23 nt, Human
ugucgcccaggcuggagcgcaau

SEQ ID NO: 528659 - RNA, 24 nt, Human
ugucgcccaggcuggagcgcaaug

SEQ ID NO: 528660 - RNA, 23 nt, Human
ugucgcccaggcuggagcgcagu

SEQ ID NO: 528661 - RNA, 24 nt, Human
ugucgcccaggcuggagcgcagug

SEQ ID NO: 528662 - RNA, 23 nt, Human
ugucgcccaggcuggagggcagu

SEQ ID NO: 528663 - RNA, 24 nt, Human
ugucgcccaggcuggagggcagug

SEQ ID NO: 528664 - RNA, 24 nt, Human
ugucgcccaggcuggagguuaaug

SEQ ID NO: 528665 - RNA, 32 nt, Human
ugucgcccaggcuggagguuaauggcaugauc

SEQ ID NO: 528666 - RNA, 19 nt, Human
ugucgcccaggcuggagua

SEQ ID NO: 528667 - RNA, 23 nt, Human
ugucgcccaggcuggaguacaau

SEQ ID NO: 528668 - RNA, 24 nt, Human
ugucgcccaggcuggaguacaaug

SEQ ID NO: 528669 - RNA, 23 nt, Human
ugucgcccaggcuggaguacagu

SEQ ID NO: 528670 - RNA, 24 nt, Human
ugucgcccaggcuggaguacagug

SEQ ID NO: 528671 - RNA, 19 nt, Human
ugucgcccaggcuggagug

SEQ ID NO: 528672 - RNA, 23 nt, Human
ugucgcccaggcuggagugagug

SEQ ID NO: 528673 - RNA, 28 nt, Human
ugucgcccaggcuggagugagugcagug

SEQ ID NO: 528674 - RNA, 32 nt, Human
ugucgcccaggcuggagugagugcaguggcgc

SEQ ID NO: 528675 - RNA, 21 nt, Human
ugucgcccaggcuggagugca

SEQ ID NO: 528676 - RNA, 23 nt, Human
ugucgcccaggcuggagugcaau

SEQ ID NO: 528677 - RNA, 24 nt, Human
ugucgcccaggcuggagugcaaug

SEQ ID NO: 528678 - RNA, 24 nt, Human
ugucgcccaggcuggagugcacug

SEQ ID NO: 528679 - RNA, 22 nt, Human
ugucgcccaggcuggagugcag

SEQ ID NO: 528680 - RNA, 23 nt, Human
ugucgcccaggcuggagugcagu

SEQ ID NO: 528681 - RNA, 24 nt, Human
ugucgcccaggcuggagugcagug

SEQ ID NO: 528682 - RNA, 32 nt, Human
ugucgcccaggcuggagugcagugagcugaga

SEQ ID NO: 528683 - RNA, 24 nt, Human
ugucgcccaggcuggagugcauug

SEQ ID NO: 528684 - RNA, 23 nt, Human
ugucgcccaggcuggagugcgau

SEQ ID NO: 528685 - RNA, 24 nt, Human
ugucgcccaggcuggagugcgaug

SEQ ID NO: 528686 - RNA, 23 nt, Human
ugucgcccaggcuggagugcggu

SEQ ID NO: 528687 - RNA, 24 nt, Human
ugucgcccaggcuggagugcggug

SEQ ID NO: 528688 - RNA, 23 nt, Human
ugucgcccaggcuggaguguagu

SEQ ID NO: 528689 - RNA, 24 nt, Human
ugucgcccaggcuggaguguagug

SEQ ID NO: 528690 - RNA, 23 nt, Human
ugucgcccaggcuggaguguggu

SEQ ID NO: 528691 - RNA, 24 nt, Human
ugucgcccaggcuggaguguggug

SEQ ID NO: 528692 - RNA, 24 nt, Human
ugucgcccaggcuggcgugaagug

SEQ ID NO: 528693 - RNA, 23 nt, Human
ugucgcccaggcuggcgugcagu

SEQ ID NO: 528694 - RNA, 24 nt, Human
ugucgcccaggcuggcgugcagug

SEQ ID NO: 528695 - RNA, 23 nt, Human
ugucgcccaggcuggggugcagu

SEQ ID NO: 528696 - RNA, 24 nt, Human
ugucgcccaggcuggggugcagug

SEQ ID NO: 528697 - RNA, 23 nt, Human
ugucgcccaggcuggguugcagu

SEQ ID NO: 528698 - RNA, 24 nt, Human
ugucgcccaggcuggguugcagug

SEQ ID NO: 528699 - RNA, 23 nt, Human
ugucgcccaggcuguagugcaau

SEQ ID NO: 528700 - RNA, 24 nt, Human
ugucgcccaggcuguagugcaaug

SEQ ID NO: 528701 - RNA, 24 nt, Human
ugucgcccaggcuguagugcagug

SEQ ID NO: 528702 - RNA, 24 nt, Human
ugucgcccagggcuggagugcagu

SEQ ID NO: 528703 - RNA, 25 nt, Human
ugucgcccagggcuggagugcagug

SEQ ID NO: 528704 - RNA, 32 nt, Human
ugucgcccagggcuggagugcaguggcgcgau

SEQ ID NO: 528705 - RNA, 23 nt, Human
ugucgcccaggguggagugcagu

SEQ ID NO: 528706 - RNA, 24 nt, Human
ugucgcccaggguggagugcagug

SEQ ID NO: 528707 - RNA, 24 nt, Human
ugucgcccaggguggagugcggug

SEQ ID NO: 528708 - RNA, 20 nt, Human
ugucgcccagguuggagugc

SEQ ID NO: 528709 - RNA, 23 nt, Human
ugucgcccagguuggagugcagu

SEQ ID NO: 528710 - RNA, 24 nt, Human
ugucgcccagguuggagugcagug

SEQ ID NO: 528711 - RNA, 24 nt, Human
ugucgcccagguuggagugccaug

SEQ ID NO: 528712 - RNA, 23 nt, Human
ugucgcccagguuguaaugcagu

SEQ ID NO: 528713 - RNA, 24 nt, Human
ugucgcccagguuguaaugcagug

SEQ ID NO: 528714 - RNA, 23 nt, Human
ugucgcccagucuguaaugcagu

SEQ ID NO: 528715 - RNA, 23 nt, Human
ugucgcccaugcuggagugcagu

SEQ ID NO: 528716 - RNA, 24 nt, Human
ugucgcccaugcuggagugcagug

SEQ ID NO: 528717 - RNA, 32 nt, Human
ugucgccccucggagcagcagccgccgcgguc

SEQ ID NO: 528718 - RNA, 31 nt, Human
ugucgccccugcaaggagguggcugaaagug

SEQ ID NO: 528719 - RNA, 32 nt, Human
ugucgcccgacaacagguaccuguacgugaac

SEQ ID NO: 528720 - RNA, 32 nt, Human
ugucgcccucggcagcucaguguucacaguca

SEQ ID NO: 528721 - RNA, 23 nt, Human
ugucgcccuggcuggagugcaau

SEQ ID NO: 528722 - RNA, 24 nt, Human
ugucgcccuggcuggagugcaaug

SEQ ID NO: 528723 - RNA, 23 nt, Human
ugucgcccuggcuggaguggaau

SEQ ID NO: 528724 - RNA, 24 nt, Human
ugucgcccuggcuggaguggaaug

SEQ ID NO: 528725 - RNA, 32 nt, Human
ugucgccgagccccgagcgcacggugaugcuc

SEQ ID NO: 528726 - RNA, 22 nt, Human
ugucgccgaggcugcagugcag

SEQ ID NO: 528727 - RNA, 21 nt, Human
ugucgccgccgccgccgccac

SEQ ID NO: 528728 - RNA, 32 nt, Human
ugucgccgccgccgccgccauuggagucgacg

SEQ ID NO: 528729 - RNA, 24 nt, Human
ugucgccuacgcuggagugcagug

SEQ ID NO: 528730 - RNA, 21 nt, Human
ugucgccuaggcuggagugca

SEQ ID NO: 528731 - RNA, 22 nt, Human
ugucgccuaggcuggagugcaa

SEQ ID NO: 528732 - RNA, 23 nt, Human
ugucgccuaggcuggagugcagu

SEQ ID NO: 528733 - RNA, 24 nt, Human
ugucgccuaggcuggagugcagug

SEQ ID NO: 528734 - RNA, 32 nt, Human
ugucgccucacugcggccucccgaguccaaag

SEQ ID NO: 528735 - RNA, 32 nt, Human
ugucgccucuggacacaaguggcgacagccug

SEQ ID NO: 528736 - RNA, 32 nt, Human
ugucgccugcagcugcucgccugucuccgucg

SEQ ID NO: 528737 - RNA, 32 nt, Human
ugucgccugcgccccggcugggcuccgggacc

SEQ ID NO: 528738 - RNA, 22 nt, Human
ugucgccuggcuggagugcagu

SEQ ID NO: 528739 - RNA, 23 nt, Human
ugucgccuggcuggagugcagug

SEQ ID NO: 528740 - RNA, 23 nt, Human
ugucgccuggcuggaguggagug

SEQ ID NO: 528741 - RNA, 23 nt, Human
ugucgccugggcuggaguacagu

SEQ ID NO: 528742 - RNA, 24 nt, Human
ugucgccugggcuggaguacagug

SEQ ID NO: 528743 - RNA, 32 nt, Human
ugucgccuguaaugccagcgcuuugggaggcg

SEQ ID NO: 528744 - RNA, 32 nt, Human
ugucgccuguggucccugucauucacucgggu

SEQ ID NO: 528745 - RNA, 23 nt, Human
ugucgcgccagcuggagugcagu

SEQ ID NO: 528746 - RNA, 32 nt, Human
ugucgcgcccgaggagggccuggaccuuucgu

SEQ ID NO: 528747 - RNA, 32 nt, Human
ugucgcgccuguaaucccagcacuuugggagg

SEQ ID NO: 528748 - RNA, 19 nt, Human
ugucgcgcgccugcagcac

SEQ ID NO: 528749 - RNA, 31 nt, Human
ugucgcgucuugauuuucccuuucuuugaug

SEQ ID NO: 528750 - RNA, 32 nt, Human
ugucgcuaguccuaaggagaaaccuuuaacca

SEQ ID NO: 528751 - RNA, 32 nt, Human
ugucgcucagccgccguccacacucgcugcag

SEQ ID NO: 528752 - RNA, 24 nt, Human
ugucgcucagccuggagugcagug

SEQ ID NO: 528753 - RNA, 23 nt, Human
ugucgcucaggcuggagugcagu

SEQ ID NO: 528754 - RNA, 24 nt, Human
ugucgcucaggcuggagugcagug

SEQ ID NO: 528755 - RNA, 32 nt, Human
ugucgcugagagccucacgagucgagguccug

SEQ ID NO: 528756 - RNA, 22 nt, Human
ugucgcugccucggccccgggc

SEQ ID NO: 528757 - RNA, 32 nt, Human
ugucgcugcugccucuguccagcugaaaugac

SEQ ID NO: 528758 - RNA, 18 nt, Human
ugucgcuggagugcagug

SEQ ID NO: 528759 - RNA, 19 nt, Human
ugucgcuggagugcagugg

SEQ ID NO: 528760 - RNA, 32 nt, Human
ugucgcuggucugugugguauucaaagcagua

SEQ ID NO: 528761 - RNA, 32 nt, Human
ugucgcugucaggcuggccaggucagcugugu

SEQ ID NO: 528762 - RNA, 32 nt, Human
ugucgcuuagauaggaaagggauccagggaaa

SEQ ID NO: 528763 - RNA, 23 nt, Human
ugucgcuuagcuggagugcggug

SEQ ID NO: 528764 - RNA, 32 nt, Human
ugucgcuucucuggugcccagcucccuuccug

SEQ ID NO: 528765 - RNA, 32 nt, Human
ugucgcuuguaaucucagcuacuugggagacu

SEQ ID NO: 528766 - RNA, 32 nt, Human
ugucggaacagugacugcugaccugccaagag

SEQ ID NO: 528767 - RNA, 32 nt, Human
ugucggagaagagagcuugccgacgaugccuu

SEQ ID NO: 528768 - RNA, 32 nt, Human
ugucggagaagcuuccgccugaagccacuaaa

SEQ ID NO: 528769 - RNA, 32 nt, Human
ugucggagccgcccgccucuuccuucagcgcg

SEQ ID NO: 528770 - RNA, 32 nt, Human
ugucggagcugcaggggucccuacccucagag

SEQ ID NO: 528771 - RNA, 32 nt, Human
ugucggagucugcacaggagagaggccuuccu

SEQ ID NO: 528772 - RNA, 25 nt, Human
ugucggcacagagguugucuucuau

SEQ ID NO: 528773 - RNA, 32 nt, Human
ugucggcaggaugcaggagcugauugggagga

SEQ ID NO: 528774 - RNA, 21 nt, Human
ugucggcaggcuaccugguca

SEQ ID NO: 528775 - RNA, 32 nt, Human
ugucggcaguccugcacuccuucuggaggcuc

SEQ ID NO: 528776 - RNA, 32 nt, Human
ugucggccacugcuggccugagagaggggguc

SEQ ID NO: 528777 - RNA, 24 nt, Human
ugucggccaggcuagagugcagug

SEQ ID NO: 528778 - RNA, 23 nt, Human
ugucggccaggcuggaaugcaau

SEQ ID NO: 528779 - RNA, 24 nt, Human
ugucggccaggcuggaaugcaaug

SEQ ID NO: 528780 - RNA, 23 nt, Human
ugucggccaggcuggagugcagu

SEQ ID NO: 528781 - RNA, 24 nt, Human
ugucggccaggcuggagugcagug

SEQ ID NO: 528782 - RNA, 32 nt, Human
ugucggccauuacggaggcuugaauaagcggu

SEQ ID NO: 528783 - RNA, 32 nt, Human
ugucggcgcuggugggagagaugagggcaauu

SEQ ID NO: 528784 - RNA, 32 nt, Human
ugucggcucacugaaccuccgccucucagguu

SEQ ID NO: 528785 - RNA, 32 nt, Human
ugucggcucacugcaaccugucucucagguug

SEQ ID NO: 528786 - RNA, 32 nt, Human
ugucggcucacugcaacguccgccuccugggu

SEQ ID NO: 528787 - RNA, 32 nt, Human
ugucggcucacugcaagcuccgccuccugggu

SEQ ID NO: 528788 - RNA, 32 nt, Human
ugucggcucacugccaacaucugccacccagg

SEQ ID NO: 528789 - RNA, 32 nt, Human
ugucggcuggggcagagacugaaauacugcca

SEQ ID NO: 528790 - RNA, 18 nt, Human
ugucggcugggugcagug

SEQ ID NO: 528791 - RNA, 32 nt, Human
ugucggcuucaaggaguccagcuuaucuuccu

SEQ ID NO: 528792 - RNA, 32 nt, Human
ugucgggacccucuggacccacccuagcgggc

SEQ ID NO: 528793 - RNA, 32 nt, Human
ugucgggagcuguaucaccuggguucuguccc

SEQ ID NO: 528794 - RNA, 32 nt, Human
ugucgggaggcugaggugggaggaucgcuuga

SEQ ID NO: 528795 - RNA, 32 nt, Human
ugucgggagucgggagucuccacgccguguga

SEQ ID NO: 528796 - RNA, 32 nt, Human
ugucgggauccgcggcagcagcggcugcuuga

SEQ ID NO: 528797 - RNA, 32 nt, Human
ugucgggcaggccgggcuuccgggaggaccug

SEQ ID NO: 528798 - RNA, 32 nt, Human
ugucgggccccggcccucuggagcuucaggag

SEQ ID NO: 528799 - RNA, 32 nt, Human
ugucggggagaaauguugcccaggaaggacag

SEQ ID NO: 528800 - RNA, 32 nt, Human
ugucgggguccagguggcacucaugggccccc

SEQ ID NO: 528801 - RNA, 32 nt, Human
ugucgggguuggcagggcaggcuuccuggagg

SEQ ID NO: 528802 - RNA, 32 nt, Human
ugucgggugggauguugagcaccugcauggga

SEQ ID NO: 528803 - RNA, 32 nt, Human
ugucggucuccaggagguugugcaugcugguu

SEQ ID NO: 528804 - RNA, 22 nt, Human
ugucggugccacccccaugcug

SEQ ID NO: 528805 - RNA, 32 nt, Human
ugucggugcucugcagggggaaauccaacaac

SEQ ID NO: 528806 - RNA, 32 nt, Human
ugucgucacaugccacauccacacacuucuua

SEQ ID NO: 528807 - RNA, 32 nt, Human
ugucgucagccugggagccuuccccaguguaa

SEQ ID NO: 528808 - RNA, 32 nt, Human
ugucguccacccuguauccugugucugagugu

SEQ ID NO: 528809 - RNA, 23 nt, Human
ugucguccaggcuggagugcagu

SEQ ID NO: 528810 - RNA, 24 nt, Human
ugucguccaggcuggagugcagug

SEQ ID NO: 528811 - RNA, 23 nt, Human
ugucguccagguuagagugcaau

SEQ ID NO: 528812 - RNA, 24 nt, Human
ugucguccagguuagagugcaaug

SEQ ID NO: 528813 - RNA, 32 nt, Human
ugucgucccuccucagcuucuuguuccuggga

SEQ ID NO: 528814 - RNA, 32 nt, Human
ugucguccguuucgggaaaaaguucuugcaua

SEQ ID NO: 528815 - RNA, 32 nt, Human
ugucguccuacccuuuuccuccaaaacaaaaa

SEQ ID NO: 528816 - RNA, 32 nt, Human
ugucguccuguccuuccuaucuccccaaagua

SEQ ID NO: 528817 - RNA, 32 nt, Human
ugucgucuacuuaagacuucuggucauuucca

SEQ ID NO: 528818 - RNA, 32 nt, Human
ugucgucuaucagcuaugugggcugcucccuc

SEQ ID NO: 528819 - RNA, 32 nt, Human
ugucgucucagccuguugguuucuccucauug

SEQ ID NO: 528820 - RNA, 24 nt, Human
ugucgucuuugacucaaguaccaa

SEQ ID NO: 528821 - RNA, 32 nt, Human
ugucgugcagugcguggugggaagagaugcca

SEQ ID NO: 528822 - RNA, 32 nt, Human
ugucguggaggaaccuagcaccugccauccuc

SEQ ID NO: 528823 - RNA, 32 nt, Human
ugucguggcacacaccuguaaucccagcuauu

SEQ ID NO: 528824 - RNA, 32 nt, Human
ugucguggcuccuugauuugaaguaaacauuu

SEQ ID NO: 528825 - RNA, 32 nt, Human
ugucgugggaggaucaugugagccugggaggu

SEQ ID NO: 528826 - RNA, 32 nt, Human
ugucguggugugcgccuguaaucucagcuacu

SEQ ID NO: 528827 - RNA, 32 nt, Human
ugucgugguuccugccuuucccagacgaccgu

SEQ ID NO: 528828 - RNA, 32 nt, Human
ugucgugucucccucccuccauggcccgggag

SEQ ID NO: 528829 - RNA, 32 nt, Human
ugucguguucucugcugcucagcccuacuggg

SEQ ID NO: 528830 - RNA, 32 nt, Human
ugucguguugaacugugucugugucagugcac

SEQ ID NO: 528831 - RNA, 31 nt, Human
ugucguucauucaaggagaguugagauacag

SEQ ID NO: 528832 - RNA, 32 nt, Human
ugucguucauucaaggagaguugagauacagu

SEQ ID NO: 528833 - RNA, 32 nt, Human
ugucguugggggaggaagugacccuuccugua

SEQ ID NO: 528834 - RNA, 32 nt, Human
ugucguuucuguuccuccuccucucucucuuu

SEQ ID NO: 528835 - RNA, 32 nt, Human
ugucuaaacuccaggauacaguauccaauuua

SEQ ID NO: 528836 - RNA, 32 nt, Human
ugucuaaagauggaacaucuugaagcauuuug

SEQ ID NO: 528837 - RNA, 32 nt, Human
ugucuaacacggugaaaccccaucucuacuaa

SEQ ID NO: 528838 - RNA, 32 nt, Human
ugucuaacauauuaugcacagacaagcuccug

SEQ ID NO: 528839 - RNA, 32 nt, Human
ugucuaagagccuguuuuggaaacacaagcug

SEQ ID NO: 528840 - RNA, 32 nt, Human
ugucuaagcucaggaggaaagggacccuccca

SEQ ID NO: 528841 - RNA, 32 nt, Human
ugucuaagugcuagacaugcucagcuuugugg

SEQ ID NO: 528842 - RNA, 32 nt, Human
ugucuacaccgcacugccauccaggcugugag

SEQ ID NO: 528843 - RNA, 31 nt, Human
ugucuacaccucucugggccuuggugucguc

SEQ ID NO: 528844 - RNA, 28 nt, Human
ugucuacagcugcuugcugagcucauca

SEQ ID NO: 528845 - RNA, 32 nt, Human
ugucuacagcuuucacaccaggcugccccucu

SEQ ID NO: 528846 - RNA, 32 nt, Human
ugucuacaggcaggaaaaccaggauggagaag

SEQ ID NO: 528847 - RNA, 32 nt, Human
ugucuacaucauaccuguggcuccagaagcuc

SEQ ID NO: 528848 - RNA, 32 nt, Human
ugucuacaugaagcucacaggcaaggauauaa

SEQ ID NO: 528849 - RNA, 32 nt, Human
ugucuaccaguagcgguccuugcccauuuggg

SEQ ID NO: 528850 - RNA, 32 nt, Human
ugucuaccguuuucagugcugugugaucauau

SEQ ID NO: 528851 - RNA, 32 nt, Human
ugucuaccuauguuauguuaaugauaucucua

SEQ ID NO: 528852 - RNA, 32 nt, Human
ugucuaccucaccaaccucgcucaucauuugg

SEQ ID NO: 528853 - RNA, 32 nt, Human
ugucuacgcacacccuauuugugcuuugcggg

SEQ ID NO: 528854 - RNA, 32 nt, Human
ugucuacuaaaaauacaaaauuagcugggcgu

SEQ ID NO: 528855 - RNA, 32 nt, Human
ugucuacucccccaaagacaaugaguuaaggg

SEQ ID NO: 528856 - RNA, 32 nt, Human
ugucuacuguaaccugcagucacugggccagg

SEQ ID NO: 528857 - RNA, 32 nt, Human
ugucuacugucggacucuacaggccagccucu

SEQ ID NO: 528858 - RNA, 32 nt, Human
ugucuacuguuggacucuacaggccagccucu

SEQ ID NO: 528859 - RNA, 32 nt, Human
ugucuacuucaauaagggucucuaaugcccca

SEQ ID NO: 528860 - RNA, 32 nt, Human
ugucuacuuucuucuccauccugcuuuaaaac

SEQ ID NO: 528861 - RNA, 32 nt, Human
ugucuagagguaaaauacgcuuuugccauuuc

SEQ ID NO: 528862 - RNA, 32 nt, Human
ugucuagagugugggcuggcuguugugcugga

SEQ ID NO: 528863 - RNA, 32 nt, Human
ugucuagccacucccucccagaaaaacuggcu

SEQ ID NO: 528864 - RNA, 32 nt, Human
ugucuaggaaacuguugagauucaaaggaauc

SEQ ID NO: 528865 - RNA, 32 nt, Human
ugucuaggauccuuuuaucaaggcaguuauga

SEQ ID NO: 528866 - RNA, 32 nt, Human
ugucuaggcaggcaagagaauugaaaugaggu

SEQ ID NO: 528867 - RNA, 32 nt, Human
ugucuaggcuacaacaggauucuagguggagg

SEQ ID NO: 528868 - RNA, 21 nt, Human
ugucuaggcuggagugccgug

SEQ ID NO: 528869 - RNA, 32 nt, Human
ugucuagggcaaacuguggcccccaggagaca

SEQ ID NO: 528870 - RNA, 32 nt, Human
ugucuaguagacaugucuaaaguucaaacuuu

SEQ ID NO: 528871 - RNA, 32 nt, Human
ugucuagucaugccuccuuccaccucccuccc

SEQ ID NO: 528872 - RNA, 32 nt, Human
ugucuauaagggcagagcauuaucuauaacgu

SEQ ID NO: 528873 - RNA, 32 nt, Human
ugucuauagagcaguuuacagacuugugucuu

SEQ ID NO: 528874 - RNA, 32 nt, Human
ugucuauccuccacuuuuaccauauucuguaa

SEQ ID NO: 528875 - RNA, 32 nt, Human
ugucuaucgggucauuugggaaugggcaggau

SEQ ID NO: 528876 - RNA, 30 nt, Human
ugucuaucuuguauaucagaaagauuaucu

SEQ ID NO: 528877 - RNA, 32 nt, Human
ugucuaucuuucucauuaauguucuuuagccu

SEQ ID NO: 528878 - RNA, 32 nt, Human
ugucuaucuuuguuucucucaccugagagaaa

SEQ ID NO: 528879 - RNA, 32 nt, Human
ugucuaugacugagcccaauugccuguugccu

SEQ ID NO: 528880 - RNA, 32 nt, Human
ugucuaugagucuaaacggggguucugaugcu

SEQ ID NO: 528881 - RNA, 32 nt, Human
ugucuaugcacaggugugaguccucuguuugc

SEQ ID NO: 528882 - RNA, 32 nt, Human
ugucuaugcaggauucuaagaugaggaaaauu

SEQ ID NO: 528883 - RNA, 32 nt, Human
ugucuauggcccccagccccagccucuggaaa

SEQ ID NO: 528884 - RNA, 32 nt, Human
ugucuauguaaaccuggaaguagucuacuuuu

SEQ ID NO: 528885 - RNA, 32 nt, Human
ugucuauguguguguuucagcacuuuguaaau

SEQ ID NO: 528886 - RNA, 32 nt, Human
ugucuauucucugagugucacguuccucaccu

SEQ ID NO: 528887 - RNA, 32 nt, Human
ugucuauugcccaggcuggagugcaguggugc

SEQ ID NO: 528888 - RNA, 32 nt, Human
ugucucaaacaugcuucuuuauuacucuguua

SEQ ID NO: 528889 - RNA, 32 nt, Human
ugucucaaagaaagaaagaaagaaaagaaaga

SEQ ID NO: 528890 - RNA, 32 nt, Human
ugucucaaagaaggguagaaguucuaaugucu

SEQ ID NO: 528891 - RNA, 22 nt, Human
ugucucaaagugcugggauuac

SEQ ID NO: 528892 - RNA, 32 nt, Human
ugucucaaagugcugggauuacagguaugagc

SEQ ID NO: 528893 - RNA, 32 nt, Human
ugucucaaccaccaccaccaccaccaccccua

SEQ ID NO: 528894 - RNA, 22 nt, Human
ugucucaacuaaaaauacaaaa

SEQ ID NO: 528895 - RNA, 32 nt, Human
ugucucaacuaauaauacaaaauuagccaggc

SEQ ID NO: 528896 - RNA, 32 nt, Human
ugucucaagauuguauaugaaggaggcuuuuc

SEQ ID NO: 528897 - RNA, 32 nt, Human
ugucucaagccuauaaucccagcacuuuggga

SEQ ID NO: 528898 - RNA, 21 nt, Human
ugucucaagccuguaauccua

SEQ ID NO: 528899 - RNA, 32 nt, Human
ugucucaagccuguaauccuagcacuuuggga

SEQ ID NO: 528900 - RNA, 32 nt, Human
ugucucaaugagaggggagacagaggcagcua

SEQ ID NO: 528901 - RNA, 32 nt, Human
ugucucacacagaacaauacaaacauguaaaa

SEQ ID NO: 528902 - RNA, 21 nt, Human
ugucucacaccuguaauccca

SEQ ID NO: 528903 - RNA, 32 nt, Human
ugucucacaccuguaaucccagcacuuugaga

SEQ ID NO: 528904 - RNA, 32 nt, Human
ugucucacaccuguaaucccagcacuuuggga

SEQ ID NO: 528905 - RNA, 32 nt, Human
ugucucacaccuguaaucccagcacuuugggu

SEQ ID NO: 528906 - RNA, 32 nt, Human
ugucucacccaggcuggagugcaguggcacga

SEQ ID NO: 528907 - RNA, 32 nt, Human
ugucucacuacccucagccuaggccaaccugg

SEQ ID NO: 528908 - RNA, 32 nt, Human
ugucucacuccccucugaccuccagaccagau

SEQ ID NO: 528909 - RNA, 32 nt, Human
ugucucacuccuguaauaccagcacuuuggga

SEQ ID NO: 528910 - RNA, 32 nt, Human
ugucucacugcaaccucugccucccggguuca

SEQ ID NO: 528911 - RNA, 23 nt, Human
ugucucagacauugucuccuccu

SEQ ID NO: 528912 - RNA, 32 nt, Human
ugucucagagcagccuuugccccagggaaaug

SEQ ID NO: 528913 - RNA, 32 nt, Human
ugucucagagcccagagccaggggagccagag

SEQ ID NO: 528914 - RNA, 32 nt, Human
ugucucagaggaggggacggcagcaccaugga

SEQ ID NO: 528915 - RNA, 32 nt, Human
ugucucagcccaggaaccaggcuuugcugagg

SEQ ID NO: 528916 - RNA, 32 nt, Human
ugucucagccuccugaguagcuaggacuacag

SEQ ID NO: 528917 - RNA, 32 nt, Human
ugucucagccuccugaguagcugagauuacag

SEQ ID NO: 528918 - RNA, 32 nt, Human
ugucucagccuccugaguagcugggauuauag

SEQ ID NO: 528919 - RNA, 32 nt, Human
ugucucagccuccugaguagcugggauuaugg

SEQ ID NO: 528920 - RNA, 32 nt, Human
ugucucagccuccuggguagcugggauuacag

SEQ ID NO: 528921 - RNA, 32 nt, Human
ugucucagcucacugcaaccuccgccucccag

SEQ ID NO: 528922 - RNA, 32 nt, Human
ugucucagcucuuguucugugccugagaaugg

SEQ ID NO: 528923 - RNA, 32 nt, Human
ugucucaggagcaaaccagccuuggcuuucag

SEQ ID NO: 528924 - RNA, 21 nt, Human
ugucucaggccuguaauccca

SEQ ID NO: 528925 - RNA, 32 nt, Human
ugucucaggcgggcugggcugcagccuucugu

SEQ ID NO: 528926 - RNA, 22 nt, Human
ugucucaggcuggaguacagug

SEQ ID NO: 528927 - RNA, 32 nt, Human
ugucucaggcuggaguacaguggugcaauugu

SEQ ID NO: 528928 - RNA, 32 nt, Human
ugucucaggcugguaguuagcaguugugacca

SEQ ID NO: 528929 - RNA, 32 nt, Human
ugucucaguucugcuugaauaccuccaucgau

SEQ ID NO: 528930 - RNA, 32 nt, Human
ugucucauaugcaaacaaagcaugucuguguc

SEQ ID NO: 528931 - RNA, 32 nt, Human
ugucucaucagcugccaccagcacucacucca

SEQ ID NO: 528932 - RNA, 32 nt, Human
ugucucaucuuugaagaaaaguauuuaagugg

SEQ ID NO: 528933 - RNA, 32 nt, Human
ugucucaugcacugaaugcaacauggacacaa

SEQ ID NO: 528934 - RNA, 21 nt, Human
ugucucaugccucuaauccca

SEQ ID NO: 528935 - RNA, 32 nt, Human
ugucucaugccucuaaucccagcacuuuggaa

SEQ ID NO: 528936 - RNA, 21 nt, Human
ugucucaugccuguaauccca

SEQ ID NO: 528937 - RNA, 32 nt, Human
ugucucaugccuguaaucccagcacuuuggga

SEQ ID NO: 528938 - RNA, 21 nt, Human
ugucucaugcucuuucuuccu

SEQ ID NO: 528939 - RNA, 32 nt, Human
ugucucauugccagugguguccaagggccccc

SEQ ID NO: 528940 - RNA, 32 nt, Human
ugucucauugcccaggcuggucucaaacuccu

SEQ ID NO: 528941 - RNA, 31 nt, Human
ugucuccaaaguccuuguuguaggaguugcu

SEQ ID NO: 528942 - RNA, 32 nt, Human
ugucuccaauccagacggagaugccaggcaca

SEQ ID NO: 528943 - RNA, 32 nt, Human
ugucuccaaugccagcacauuugugacuugua

SEQ ID NO: 528944 - RNA, 32 nt, Human
ugucuccacagagcagcuugggcacagcagac

SEQ ID NO: 528945 - RNA, 32 nt, Human
ugucuccacagcaaccagccacugcaggcagc

SEQ ID NO: 528946 - RNA, 22 nt, Human
ugucuccaccaaaaauacaaaa

SEQ ID NO: 528947 - RNA, 23 nt, Human
ugucuccacuaaaaaauacaaaa

SEQ ID NO: 528948 - RNA, 22 nt, Human
ugucuccacuaaaaacacaaaa

SEQ ID NO: 528949 - RNA, 22 nt, Human
ugucuccacuaaaaauacaaaa

SEQ ID NO: 528950 - RNA, 32 nt, Human
ugucuccacuaaaaauacaaaaauuagccggg

SEQ ID NO: 528951 - RNA, 32 nt, Human
ugucuccacuaaaaauacaaaauuagccgggu

SEQ ID NO: 528952 - RNA, 22 nt, Human
ugucuccacugaaaauacaaaa

SEQ ID NO: 528953 - RNA, 32 nt, Human
ugucuccacugcauucuccagagguaaagauu

SEQ ID NO: 528954 - RNA, 32 nt, Human
ugucuccacuucacuccagcaucaacaagugg

SEQ ID NO: 528955 - RNA, 32 nt, Human
ugucuccacuucagaaagaaagcaagaggcac

SEQ ID NO: 528956 - RNA, 20 nt, Human
ugucuccagcacuaugcauc

SEQ ID NO: 528957 - RNA, 32 nt, Human
ugucuccagccugcccacuucccuucaugaau

SEQ ID NO: 528958 - RNA, 32 nt, Human
ugucuccagcuuccagcccuccuccccuaagc

SEQ ID NO: 528959 - RNA, 22 nt, Human
ugucuccaggcuggagugcagu

SEQ ID NO: 528960 - RNA, 23 nt, Human
ugucuccaggcuggagugcagug

SEQ ID NO: 528961 - RNA, 32 nt, Human
ugucuccauccucugcugaugccugcugucuu

SEQ ID NO: 528962 - RNA, 32 nt, Human
ugucuccauggaugacguccagaaggauguca

SEQ ID NO: 528963 - RNA, 19 nt, Human
ugucuccauuccugccauc

SEQ ID NO: 528964 - RNA, 32 nt, Human
ugucucccaaagagcugggauuacaggcguga

SEQ ID NO: 528965 - RNA, 32 nt, Human
ugucucccaaagugcuaggauuacagguguga

SEQ ID NO: 528966 - RNA, 32 nt, Human
ugucucccaaagugcugggaugccaggcguga

SEQ ID NO: 528967 - RNA, 32 nt, Human
ugucucccaaguagcuggaacuacaggcaugc

SEQ ID NO: 528968 - RNA, 24 nt, Human
ugucucccagaacuauucuggggg

SEQ ID NO: 528969 - RNA, 32 nt, Human
ugucucccagcagacugguggcaugcccagug

SEQ ID NO: 528970 - RNA, 32 nt, Human
ugucucccagcccacauaggaggucugggcag

SEQ ID NO: 528971 - RNA, 32 nt, Human
ugucucccagcucccaccccagccacugauga

SEQ ID NO: 528972 - RNA, 23 nt, Human
ugucucccaggccggagugcagu

SEQ ID NO: 528973 - RNA, 24 nt, Human
ugucucccaggccggagugcagug

SEQ ID NO: 528974 - RNA, 24 nt, Human
ugucucccaggcuagaguaccgug

SEQ ID NO: 528975 - RNA, 23 nt, Human
ugucucccaggcuagagugcaau

SEQ ID NO: 528976 - RNA, 24 nt, Human
ugucucccaggcuagagugcaaug

SEQ ID NO: 528977 - RNA, 23 nt, Human
ugucucccaggcugaagugcagu

SEQ ID NO: 528978 - RNA, 24 nt, Human
ugucucccaggcugaagugcagug

SEQ ID NO: 528979 - RNA, 32 nt, Human
ugucucccaggcugaagugcagugagucaaga

SEQ ID NO: 528980 - RNA, 32 nt, Human
ugucucccaggcugcuggagugcaguggcaca

SEQ ID NO: 528981 - RNA, 22 nt, Human
ugucucccaggcuggacugcag

SEQ ID NO: 528982 - RNA, 24 nt, Human
ugucucccaggcuggacugcagug

SEQ ID NO: 528983 - RNA, 23 nt, Human
ugucucccaggcuggagcguagu

SEQ ID NO: 528984 - RNA, 32 nt, Human
ugucucccaggcuggaggucaguggcacaaau

SEQ ID NO: 528985 - RNA, 19 nt, Human
ugucucccaggcuggagua

SEQ ID NO: 528986 - RNA, 24 nt, Human
ugucucccaggcuggaguacagug

SEQ ID NO: 528987 - RNA, 20 nt, Human
ugucucccaggcuggagugc

SEQ ID NO: 528988 - RNA, 21 nt, Human
ugucucccaggcuggagugca

SEQ ID NO: 528989 - RNA, 23 nt, Human
ugucucccaggcuggagugcaau

SEQ ID NO: 528990 - RNA, 24 nt, Human
ugucucccaggcuggagugcaaug

SEQ ID NO: 528991 - RNA, 23 nt, Human
ugucucccaggcuggagugcagu

SEQ ID NO: 528992 - RNA, 24 nt, Human
ugucucccaggcuggagugcagug

SEQ ID NO: 528993 - RNA, 24 nt, Human
ugucucccaggcuggagugcggug

SEQ ID NO: 528994 - RNA, 24 nt, Human
ugucucccaggcuggagugcuaug

SEQ ID NO: 528995 - RNA, 24 nt, Human
ugucucccagguuggagugcagug

SEQ ID NO: 528996 - RNA, 32 nt, Human
ugucucccaguucuagagguucccagagaaga

SEQ ID NO: 528997 - RNA, 32 nt, Human
ugucuccccacacauccgaugugcuucucccu

SEQ ID NO: 528998 - RNA, 32 nt, Human
ugucucccccagcugccacacacacauuuugu

SEQ ID NO: 528999 - RNA, 24 nt, Human
ugucuccccggcuggagugcagug

SEQ ID NO: 529000 - RNA, 32 nt, Human
ugucuccccugccccacugcuggaacagaggc

SEQ ID NO: 529001 - RNA, 32 nt, Human
ugucucccgaguaguuggaauuacaggugcau

SEQ ID NO: 529002 - RNA, 32 nt, Human
ugucucccgguuccuuucucucugcuccugac

SEQ ID NO: 529003 - RNA, 32 nt, Human
ugucucccuagagguacuaguaucuagaguuu

SEQ ID NO: 529004 - RNA, 32 nt, Human
ugucucccuccagagccucccuccggacaaug

SEQ ID NO: 529005 - RNA, 32 nt, Human
ugucucccucccuguucucugccucuuguacc

SEQ ID NO: 529006 - RNA, 21 nt, Human
ugucucccuccucugccccca

SEQ ID NO: 529007 - RNA, 32 nt, Human
ugucucccucucucacacacacaagagcaguu

SEQ ID NO: 529008 - RNA, 32 nt, Human
ugucucccugcuccucuacuggugaugggcua

SEQ ID NO: 529009 - RNA, 32 nt, Human
ugucucccugcucgcuccgggucccggcgccg

SEQ ID NO: 529010 - RNA, 32 nt, Human
ugucucccuugccucuggcccagcagagccua

SEQ ID NO: 529011 - RNA, 32 nt, Human
ugucuccgcacguguugggccacagcaaggcg

SEQ ID NO: 529012 - RNA, 32 nt, Human
ugucuccgcugccuccuucuccacuucuacaa

SEQ ID NO: 529013 - RNA, 32 nt, Human
ugucuccggagucucugaagcuguaguuguac

SEQ ID NO: 529014 - RNA, 32 nt, Human
ugucuccggggugcccugaccaaccugcccgc

SEQ ID NO: 529015 - RNA, 23 nt, Human
ugucuccuaagcuggagugcagu

SEQ ID NO: 529016 - RNA, 24 nt, Human
ugucuccuaagcuggagugcagug

SEQ ID NO: 529017 - RNA, 32 nt, Human
ugucuccuaagcuggagugcaguggcaucauc

SEQ ID NO: 529018 - RNA, 32 nt, Human
ugucuccuaagugcccucagacagcagugacg

SEQ ID NO: 529019 - RNA, 32 nt, Human
ugucuccuacuauccaaaaugugcaucacagg

SEQ ID NO: 529020 - RNA, 32 nt, Human
ugucuccuacuucauucggaacauggaggagu

SEQ ID NO: 529021 - RNA, 23 nt, Human
ugucuccuaggcuggagugcagu

SEQ ID NO: 529022 - RNA, 24 nt, Human
ugucuccuaggcuggagugcagug

SEQ ID NO: 529023 - RNA, 23 nt, Human
ugucuccuaggguuauccugcuc

SEQ ID NO: 529024 - RNA, 23 nt, Human
ugucuccucacccacccccagcc

SEQ ID NO: 529025 - RNA, 23 nt, Human
ugucuccucacccccagcugcca

SEQ ID NO: 529026 - RNA, 21 nt, Human
ugucuccucagcugcucacca

SEQ ID NO: 529027 - RNA, 32 nt, Human
ugucuccucagggcagggcccagcacacugcc

SEQ ID NO: 529028 - RNA, 32 nt, Human
ugucuccuccacucuccuccucacccucucgc

SEQ ID NO: 529029 - RNA, 23 nt, Human
ugucuccuccagggccccagcca

SEQ ID NO: 529030 - RNA, 32 nt, Human
ugucuccuccagguacccccuaagccugcacu

SEQ ID NO: 529031 - RNA, 22 nt, Human
ugucuccucccucccaugcucc

SEQ ID NO: 529032 - RNA, 32 nt, Human
ugucuccucccucccaugcuccuuggcuucug

SEQ ID NO: 529033 - RNA, 23 nt, Human
ugucuccucccugcugugcuucc

SEQ ID NO: 529034 - RNA, 32 nt, Human
ugucuccuccggggacccagacugccuucauc

SEQ ID NO: 529035 - RNA, 20 nt, Human
ugucuccuccuagugcuucc

SEQ ID NO: 529036 - RNA, 31 nt, Human
ugucuccuccucucuguguccacuguccuga

SEQ ID NO: 529037 - RNA, 32 nt, Human
ugucuccucugcagaggcggauuucccugacu

SEQ ID NO: 529038 - RNA, 32 nt, Human
ugucuccucugcccagaggggcagcagcucuc

SEQ ID NO: 529039 - RNA, 32 nt, Human
ugucuccugcagcucagcagcugccuucacca

SEQ ID NO: 529040 - RNA, 32 nt, Human
ugucuccugcauauccagccuccugcgacucc

SEQ ID NO: 529041 - RNA, 32 nt, Human
ugucuccugccucugucuuucuuggugucugu

SEQ ID NO: 529042 - RNA, 32 nt, Human
ugucuccugccuguaaucccaucacuuuggga

SEQ ID NO: 529043 - RNA, 32 nt, Human
ugucuccugcucuucuggagccuggaaggaaa

SEQ ID NO: 529044 - RNA, 32 nt, Human
ugucuccugcuuggaaagucucucuucugaac

SEQ ID NO: 529045 - RNA, 32 nt, Human
ugucuccuggccgucugcuccaggcgcagcug

SEQ ID NO: 529046 - RNA, 32 nt, Human
ugucuccugggcuguggucucaucucaacguu

SEQ ID NO: 529047 - RNA, 32 nt, Human
ugucuccuggggacuuugccuacuggggaccu

SEQ ID NO: 529048 - RNA, 23 nt, Human
ugucuccugggucccugccccca

SEQ ID NO: 529049 - RNA, 32 nt, Human
ugucuccugguucaggaacacucucucaggag

SEQ ID NO: 529050 - RNA, 32 nt, Human
ugucuccugugggcagcgcucaggaccacccu

SEQ ID NO: 529051 - RNA, 24 nt, Human
ugucuccuuccacaguuuacuucc

SEQ ID NO: 529052 - RNA, 32 nt, Human
ugucuccuuccauuaucccucuccuucccucc

SEQ ID NO: 529053 - RNA, 22 nt, Human
ugucuccuucccccacucaucc

SEQ ID NO: 529054 - RNA, 32 nt, Human
ugucuccuucugcacccagaguagggguggag

SEQ ID NO: 529055 - RNA, 32 nt, Human
ugucuccuuugcaggcucauagggaagaccug

SEQ ID NO: 529056 - RNA, 32 nt, Human
ugucuccuuuggcugaggagaguguccuggcc

SEQ ID NO: 529057 - RNA, 21 nt, Human
ugucuccuuuucaugugaauu

SEQ ID NO: 529058 - RNA, 32 nt, Human
ugucucgacucacugcaaccuccgccucccga

SEQ ID NO: 529059 - RNA, 32 nt, Human
ugucucgucuaaaaauacaaaaauuagccggg

SEQ ID NO: 529060 - RNA, 32 nt, Human
ugucucgucuuuccuccuuagaagaacagacc

SEQ ID NO: 529061 - RNA, 32 nt, Human
ugucucuaagaggugcugccccaaagcucccc

SEQ ID NO: 529062 - RNA, 32 nt, Human
ugucucuaaggguggccccuccucucaggcgu

SEQ ID NO: 529063 - RNA, 22 nt, Human
ugucucuaauaaaaauacaaaa

SEQ ID NO: 529064 - RNA, 32 nt, Human
ugucucuaauaaaaauacaaaaauuagccagg

SEQ ID NO: 529065 - RNA, 32 nt, Human
ugucucuaauaaaaauacgaaaaauuagcugg

SEQ ID NO: 529066 - RNA, 32 nt, Human
ugucucuaauguccuuugcaccacugaccuug

SEQ ID NO: 529067 - RNA, 22 nt, Human
ugucucuacaaaaaauacaaaa

SEQ ID NO: 529068 - RNA, 32 nt, Human
ugucucuacaaaaaguagaaaaauuagcugag

SEQ ID NO: 529069 - RNA, 32 nt, Human
ugucucuacaaaacauacaaaaauuagcugag

SEQ ID NO: 529070 - RNA, 22 nt, Human
ugucucuacagaaaauacaaaa

SEQ ID NO: 529071 - RNA, 32 nt, Human
ugucucuacagaaaguuuuaaaauuagccagg

SEQ ID NO: 529072 - RNA, 32 nt, Human
ugucucuacagaagauacaaaaauuggcuggg

SEQ ID NO: 529073 - RNA, 22 nt, Human
ugucucuacauaaaauacaaaa

SEQ ID NO: 529074 - RNA, 32 nt, Human
ugucucuacauaaaauacaaaaacuuagaugg

SEQ ID NO: 529075 - RNA, 32 nt, Human
ugucucuacauaaaauacaaaaauuagcuggg

SEQ ID NO: 529076 - RNA, 21 nt, Human
ugucucuaccaaaaaauaaaa

SEQ ID NO: 529077 - RNA, 32 nt, Human
ugucucuaccaaaaacacacaaagaaauuagc

SEQ ID NO: 529078 - RNA, 22 nt, Human
ugucucuaccaaaaauaaaaaa

SEQ ID NO: 529079 - RNA, 22 nt, Human
ugucucuaccaaaaauacaaaa

SEQ ID NO: 529080 - RNA, 32 nt, Human
ugucucuaccaaaaauacaaaaauuagccacg

SEQ ID NO: 529081 - RNA, 32 nt, Human
ugucucuaccaaaaauacaaaaauuagccagg

SEQ ID NO: 529082 - RNA, 32 nt, Human
ugucucuaccaaaaauacaaaaauuagccggg

SEQ ID NO: 529083 - RNA, 32 nt, Human
ugucucuaccaaaaauacaaaaauuagcuaga

SEQ ID NO: 529084 - RNA, 32 nt, Human
ugucucuaccaaaaauacaaaaauuagcuggg

SEQ ID NO: 529085 - RNA, 22 nt, Human
ugucucuaccaaaaauacaaga

SEQ ID NO: 529086 - RNA, 22 nt, Human
ugucucuaccaaaaauacagaa

SEQ ID NO: 529087 - RNA, 32 nt, Human
ugucucuaccaaaauaaaaauuagcugggcau

SEQ ID NO: 529088 - RNA, 21 nt, Human
ugucucuaccaaaauacaaaa

SEQ ID NO: 529089 - RNA, 32 nt, Human
ugucucuaccaaaauacaaaaauuagccgggc

SEQ ID NO: 529090 - RNA, 22 nt, Human
ugucucuaccaaaauuacaaaa

SEQ ID NO: 529091 - RNA, 32 nt, Human
ugucucuaccaaaauuacaaaaauuagccgag

SEQ ID NO: 529092 - RNA, 31 nt, Human
ugucucuaccucucugccugucuccuuccac

SEQ ID NO: 529093 - RNA, 32 nt, Human
ugucucuacgaaaaauagaaaaauuagccaga

SEQ ID NO: 529094 - RNA, 23 nt, Human
ugucucuacuaaaaaauaaaaua

SEQ ID NO: 529095 - RNA, 23 nt, Human
ugucucuacuaaaaaauacaaaa

SEQ ID NO: 529096 - RNA, 24 nt, Human
ugucucuacuaaaaaauacaaaau

SEQ ID NO: 529097 - RNA, 21 nt, Human
ugucucuacuaaaaacacaaa

SEQ ID NO: 529098 - RNA, 22 nt, Human
ugucucuacuaaaaacacaaaa

SEQ ID NO: 529099 - RNA, 32 nt, Human
ugucucuacuaaaaacacaaaaauuagccagg

SEQ ID NO: 529100 - RNA, 32 nt, Human
ugucucuacuaaaaacacaaaaauuagcugag

SEQ ID NO: 529101 - RNA, 32 nt, Human
ugucucuacuaaaaacacaaaaauuagcuggg

SEQ ID NO: 529102 - RNA, 32 nt, Human
ugucucuacuaaaaacacaaaaauuaucuggg

SEQ ID NO: 529103 - RNA, 32 nt, Human
ugucucuacuaaaaacacaaacauuagccggg

SEQ ID NO: 529104 - RNA, 22 nt, Human
ugucucuacuaaaaacauaaaa

SEQ ID NO: 529105 - RNA, 32 nt, Human
ugucucuacuaaaaacauaaaaauuagcuggg

SEQ ID NO: 529106 - RNA, 32 nt, Human
ugucucuacuaaaaacauggaaauuagccaag

SEQ ID NO: 529107 - RNA, 23 nt, Human
ugucucuacuaaaaacuacaaaa

SEQ ID NO: 529108 - RNA, 22 nt, Human
ugucucuacuaaaaagacaaaa

SEQ ID NO: 529109 - RNA, 22 nt, Human
ugucucuacuaaaaauaaaaaa

SEQ ID NO: 529110 - RNA, 32 nt, Human
ugucucuacuaaaaauaaaauuagccaggugc

SEQ ID NO: 529111 - RNA, 19 nt, Human
ugucucuacuaaaaauaca

SEQ ID NO: 529112 - RNA, 20 nt, Human
ugucucuacuaaaaauacaa

SEQ ID NO: 529113 - RNA, 22 nt, Human
ugucucuacuaaaaauacaaaa

SEQ ID NO: 529114 - RNA, 32 nt, Human
ugucucuacuaaaaauacaaaaacuagccugg

SEQ ID NO: 529115 - RNA, 32 nt, Human
ugucucuacuaaaaauacaaaaagccaggugu

SEQ ID NO: 529116 - RNA, 32 nt, Human
ugucucuacuaaaaauacaaaaaguagccagc

SEQ ID NO: 529117 - RNA, 32 nt, Human
ugucucuacuaaaaauacaaaaaguagccagg

SEQ ID NO: 529118 - RNA, 32 nt, Human
ugucucuacuaaaaauacaaaaaucagccggg

SEQ ID NO: 529119 - RNA, 32 nt, Human
ugucucuacuaaaaauacaaaaaugagccggg

SEQ ID NO: 529120 - RNA, 32 nt, Human
ugucucuacuaaaaauacaaaaaugagcuggg

SEQ ID NO: 529121 - RNA, 32 nt, Human
ugucucuacuaaaaauacaaaaauuagauggg

SEQ ID NO: 529122 - RNA, 32 nt, Human
ugucucuacuaaaaauacaaaaauuagcagag

SEQ ID NO: 529123 - RNA, 32 nt, Human
ugucucuacuaaaaauacaaaaauuagccaga

SEQ ID NO: 529124 - RNA, 32 nt, Human
ugucucuacuaaaaauacaaaaauuagccagg

SEQ ID NO: 529125 - RNA, 32 nt, Human
ugucucuacuaaaaauacaaaaauuagcccga

SEQ ID NO: 529126 - RNA, 32 nt, Human
ugucucuacuaaaaauacaaaaauuagccgag

SEQ ID NO: 529127 - RNA, 32 nt, Human
ugucucuacuaaaaauacaaaaauuagccggc

SEQ ID NO: 529128 - RNA, 32 nt, Human
ugucucuacuaaaaauacaaaaauuagccggg

SEQ ID NO: 529129 - RNA, 32 nt, Human
ugucucuacuaaaaauacaaaaauuagccugg

SEQ ID NO: 529130 - RNA, 32 nt, Human
ugucucuacuaaaaauacaaaaauuagcugau

SEQ ID NO: 529131 - RNA, 32 nt, Human
ugucucuacuaaaaauacaaaaauuagcugca

SEQ ID NO: 529132 - RNA, 32 nt, Human
ugucucuacuaaaaauacaaaaauuagcuggg

SEQ ID NO: 529133 - RNA, 32 nt, Human
ugucucuacuaaaaauacaaaaauuaggccgg

SEQ ID NO: 529134 - RNA, 32 nt, Human
ugucucuacuaaaaauacaaaaauuagucggg

SEQ ID NO: 529135 - RNA, 32 nt, Human
ugucucuacuaaaaauacaaaaauuauccagu

SEQ ID NO: 529136 - RNA, 32 nt, Human
ugucucuacuaaaaauacaaaaauuaucuggg

SEQ ID NO: 529137 - RNA, 32 nt, Human
ugucucuacuaaaaauacaaaaauuaugguga

SEQ ID NO: 529138 - RNA, 32 nt, Human
ugucucuacuaaaaauacaaaaauuggccggg

SEQ ID NO: 529139 - RNA, 32 nt, Human
ugucucuacuaaaaauacaaaaauuuagccag

SEQ ID NO: 529140 - RNA, 32 nt, Human
ugucucuacuaaaaauacaaaaauuugccggg

SEQ ID NO: 529141 - RNA, 32 nt, Human
ugucucuacuaaaaauacaaaacuagcugggc

SEQ ID NO: 529142 - RNA, 32 nt, Human
ugucucuacuaaaaauacaaaaguuagcuggg

SEQ ID NO: 529143 - RNA, 23 nt, Human
ugucucuacuaaaaauacaaaau

SEQ ID NO: 529144 - RNA, 32 nt, Human
ugucucuacuaaaaauacaaaaucagccaggc

SEQ ID NO: 529145 - RNA, 32 nt, Human
ugucucuacuaaaaauacaaaauuaacugggu

SEQ ID NO: 529146 - RNA, 32 nt, Human
ugucucuacuaaaaauacaaaauuagccaggc

SEQ ID NO: 529147 - RNA, 32 nt, Human
ugucucuacuaaaaauacaaaauuagccaugc

SEQ ID NO: 529148 - RNA, 32 nt, Human
ugucucuacuaaaaauacaaaauuagcugggc

SEQ ID NO: 529149 - RNA, 32 nt, Human
ugucucuacuaaaaauacaaaauuagcugggu

SEQ ID NO: 529150 - RNA, 32 nt, Human
ugucucuacuaaaaauacaaacauuagcccgg

SEQ ID NO: 529151 - RNA, 22 nt, Human
ugucucuacuaaaaauacaaga

SEQ ID NO: 529152 - RNA, 32 nt, Human
ugucucuacuaaaaauacaagaauuagcuggg

SEQ ID NO: 529153 - RNA, 32 nt, Human
ugucucuacuaaaaauacaaguaaauaagcca

SEQ ID NO: 529154 - RNA, 32 nt, Human
ugucucuacuaaaaauacaauaauuagccagg

SEQ ID NO: 529155 - RNA, 32 nt, Human
ugucucuacuaaaaauacaauuagccaggugu

SEQ ID NO: 529156 - RNA, 22 nt, Human
ugucucuacuaaaaauacagaa

SEQ ID NO: 529157 - RNA, 32 nt, Human
ugucucuacuaaaaauacagaaaaauuagcca

SEQ ID NO: 529158 - RNA, 32 nt, Human
ugucucuacuaaaaauacauaaacuuagccgg

SEQ ID NO: 529159 - RNA, 23 nt, Human
ugucucuacuaaaaauaccaaaa

SEQ ID NO: 529160 - RNA, 32 nt, Human
ugucucuacuaaaaauacgaaaauuagccugg

SEQ ID NO: 529161 - RNA, 22 nt, Human
ugucucuacuaaaaauauaaaa

SEQ ID NO: 529162 - RNA, 32 nt, Human
ugucucuacuaaaaauauaaaaauuagccagg

SEQ ID NO: 529163 - RNA, 32 nt, Human
ugucucuacuaaaaauauaaaaauuaggccag

SEQ ID NO: 529164 - RNA, 32 nt, Human
ugucucuacuaaaaauauaaaaauuagucggg

SEQ ID NO: 529165 - RNA, 23 nt, Human
ugucucuacuaaaaauauaaaau

SEQ ID NO: 529166 - RNA, 32 nt, Human
ugucucuacuaaaaauauaaaaucagccaggc

SEQ ID NO: 529167 - RNA, 32 nt, Human
ugucucuacuaaaaauaugaaaauuagcuggg

SEQ ID NO: 529168 - RNA, 23 nt, Human
ugucucuacuaaaaaucccaaaa

SEQ ID NO: 529169 - RNA, 22 nt, Human
ugucucuacuaaaaaugcaaaa

SEQ ID NO: 529170 - RNA, 32 nt, Human
ugucucuacuaaaaaugcaaaaacuagccggg

SEQ ID NO: 529171 - RNA, 32 nt, Human
ugucucuacuaaaaaugcaaaaauuagccggg

SEQ ID NO: 529172 - RNA, 32 nt, Human
ugucucuacuaaaaaugcaaaaauuagcugga

SEQ ID NO: 529173 - RNA, 23 nt, Human
ugucucuacuaaaaaugcaaaau

SEQ ID NO: 529174 - RNA, 32 nt, Human
ugucucuacuaaaaaugcaaaauuagucaggc

SEQ ID NO: 529175 - RNA, 32 nt, Human
ugucucuacuaaaaauuaaaaauuagcuggac

SEQ ID NO: 529176 - RNA, 23 nt, Human
ugucucuacuaaaaauuacaaaa

SEQ ID NO: 529177 - RNA, 32 nt, Human
ugucucuacuaaaaauuagccaagugugguaa

SEQ ID NO: 529178 - RNA, 22 nt, Human
ugucucuacuaaaaauuuaaaa

SEQ ID NO: 529179 - RNA, 32 nt, Human
ugucucuacuaaaaauuuaaaaauuagcuggg

SEQ ID NO: 529180 - RNA, 25 nt, Human
ugucucuacuaaaacaaauacaaaa

SEQ ID NO: 529181 - RNA, 22 nt, Human
ugucucuacuaaaacgauaaaa

SEQ ID NO: 529182 - RNA, 22 nt, Human
ugucucuacuaaaacuacaaaa

SEQ ID NO: 529183 - RNA, 32 nt, Human
ugucucuacuaaaacuacaaaaauuggccagg

SEQ ID NO: 529184 - RNA, 22 nt, Human
ugucucuacuaaaaguacaaaa

SEQ ID NO: 529185 - RNA, 32 nt, Human
ugucucuacuaaaaguacaaaaauuagccggg

SEQ ID NO: 529186 - RNA, 32 nt, Human
ugucucuacuaaaaguacaaaaauuagcugga

SEQ ID NO: 529187 - RNA, 32 nt, Human
ugucucuacuaaaaguacagaauuagccgggc

SEQ ID NO: 529188 - RNA, 32 nt, Human
ugucucuacuaaaaguaccaaaaugagccaag

SEQ ID NO: 529189 - RNA, 22 nt, Human
ugucucuacuaaaaguauaaaa

SEQ ID NO: 529190 - RNA, 21 nt, Human
ugucucuacuaaaauacaaaa

SEQ ID NO: 529191 - RNA, 32 nt, Human
ugucucuacuaaaauacaaaaauuagcugggc

SEQ ID NO: 529192 - RNA, 22 nt, Human
ugucucuacuaaaauuacaaaa

SEQ ID NO: 529193 - RNA, 32 nt, Human
ugucucuacuaaaauuacaaaaauuagccggc

SEQ ID NO: 529194 - RNA, 32 nt, Human
ugucucuacuaaacauacaaaaauuagcuagg

SEQ ID NO: 529195 - RNA, 22 nt, Human
ugucucuacuaaagauacaaaa

SEQ ID NO: 529196 - RNA, 22 nt, Human
ugucucuacuaaagauauaaaa

SEQ ID NO: 529197 - RNA, 32 nt, Human
ugucucuacuaaagauauaaaaauuagcugga

SEQ ID NO: 529198 - RNA, 22 nt, Human
ugucucuacuaaauauacaaaa

SEQ ID NO: 529199 - RNA, 32 nt, Human
ugucucuacuaaauauacaaaaauuagcuggg

SEQ ID NO: 529200 - RNA, 32 nt, Human
ugucucuacuaaauauacaaaaauuaguuggg

SEQ ID NO: 529201 - RNA, 32 nt, Human
ugucucuacuaacaauauaaaaauuagcuggg

SEQ ID NO: 529202 - RNA, 23 nt, Human
ugucucuacuaagaauacaaaau

SEQ ID NO: 529203 - RNA, 32 nt, Human
ugucucuacuaagaauacaaaauuagcugggc

SEQ ID NO: 529204 - RNA, 32 nt, Human
ugucucuacuaagaauauaaaaauuagcuggg

SEQ ID NO: 529205 - RNA, 23 nt, Human
ugucucuacuaaggauacaaaau

SEQ ID NO: 529206 - RNA, 32 nt, Human
ugucucuacuaaggauacaaaauuagccgggc

SEQ ID NO: 529207 - RNA, 32 nt, Human
ugucucuacuacaaauacaaaaauuagccagg

SEQ ID NO: 529208 - RNA, 32 nt, Human
ugucucuacuacaaauacgaaaauuagcuggg

SEQ ID NO: 529209 - RNA, 32 nt, Human
ugucucuacuaccucagaaacugcagcuuggu

SEQ ID NO: 529210 - RNA, 22 nt, Human
ugucucuacuagaaauacaaaa

SEQ ID NO: 529211 - RNA, 32 nt, Human
ugucucuacuagaaauacaaaaauuagccagg

SEQ ID NO: 529212 - RNA, 32 nt, Human
ugucucuacuauuuagggguugaaaauccauu

SEQ ID NO: 529213 - RNA, 32 nt, Human
ugucucuacuccuuaaacuuguaccacuuuga

SEQ ID NO: 529214 - RNA, 22 nt, Human
ugucucuacugaaaauacaaaa

SEQ ID NO: 529215 - RNA, 32 nt, Human
ugucucuacugaaaauacaaaaauuagccggg

SEQ ID NO: 529216 - RNA, 32 nt, Human
ugucucuacugaaaauacaaaaauuagcuggg

SEQ ID NO: 529217 - RNA, 32 nt, Human
ugucucuacugaaaaugcaaaaauuagccagg

SEQ ID NO: 529218 - RNA, 21 nt, Human
ugucucuacugaaauacaaaa

SEQ ID NO: 529219 - RNA, 32 nt, Human
ugucucuagaaaacauagcuucuuacugaacu

SEQ ID NO: 529220 - RNA, 32 nt, Human
ugucucuagaaaggaauccugucuuaaaacug

SEQ ID NO: 529221 - RNA, 22 nt, Human
ugucucuaguaaaaauacaaaa

SEQ ID NO: 529222 - RNA, 32 nt, Human
ugucucuagugaaaauacaaaaauuagccagg

SEQ ID NO: 529223 - RNA, 22 nt, Human
ugucucuauaaaaaauacaaaa

SEQ ID NO: 529224 - RNA, 22 nt, Human
ugucucuaucaaaaauacaaaa

SEQ ID NO: 529225 - RNA, 32 nt, Human
ugucucuaucaaaaauacaaaaauuagcuggc

SEQ ID NO: 529226 - RNA, 22 nt, Human
ugucucuauuaaaaacacaaaa

SEQ ID NO: 529227 - RNA, 32 nt, Human
ugucucuauuaaaaacacaaaaauuagccaga

SEQ ID NO: 529228 - RNA, 32 nt, Human
ugucucuauuaaaaauaaaaaugauuggccga

SEQ ID NO: 529229 - RNA, 22 nt, Human
ugucucuauuaaaaauacaaaa

SEQ ID NO: 529230 - RNA, 32 nt, Human
ugucucuauuaaaaauacaaaaauuagccagg

SEQ ID NO: 529231 - RNA, 32 nt, Human
ugucucuauuaaaaauacaaaaauuagcuggg

SEQ ID NO: 529232 - RNA, 32 nt, Human
ugucucuauuaaaaauacaaaaauuaggcaug

SEQ ID NO: 529233 - RNA, 32 nt, Human
ugucucuauuaaaaauaccaaaauuagcuggg

SEQ ID NO: 529234 - RNA, 32 nt, Human
ugucucuauuaaaaguacaaaauggagcuggg

SEQ ID NO: 529235 - RNA, 32 nt, Human
ugucucucaaaugaucagacaaagguguuuug

SEQ ID NO: 529236 - RNA, 32 nt, Human
ugucucucagacuguacaugcauuaaaauuuu

SEQ ID NO: 529237 - RNA, 32 nt, Human
ugucucucagcauugcuuuauuacaaaguaaa

SEQ ID NO: 529238 - RNA, 32 nt, Human
ugucucucaggaucaagcugaagugggggaau

SEQ ID NO: 529239 - RNA, 24 nt, Human
ugucucucagucauuccccugggg

SEQ ID NO: 529240 - RNA, 32 nt, Human
ugucucuccagccuuugaagauugggcuccua

SEQ ID NO: 529241 - RNA, 32 nt, Human
ugucucuccauggccugagcagggagauuaua

SEQ ID NO: 529242 - RNA, 32 nt, Human
ugucucuccauuccucuccaacccugcccacc

SEQ ID NO: 529243 - RNA, 32 nt, Human
ugucucucccaagaauacaaaaauuagccagg

SEQ ID NO: 529244 - RNA, 32 nt, Human
ugucucucccacaggucauucuccugugacac

SEQ ID NO: 529245 - RNA, 31 nt, Human
ugucucucccauauuauaccugugucagcca

SEQ ID NO: 529246 - RNA, 32 nt, Human
ugucucuccccauguuucuccccacuagaagc

SEQ ID NO: 529247 - RNA, 22 nt, Human
ugucucuccuaaaaauacaaaa

SEQ ID NO: 529248 - RNA, 32 nt, Human
ugucucuccuaaaaauacaaaaauuagcugga

SEQ ID NO: 529249 - RNA, 32 nt, Human
ugucucuccuaaaaauacaaaaauuggccggg

SEQ ID NO: 529250 - RNA, 32 nt, Human
ugucucuccuaaaaauacaaaauuagccgggc

SEQ ID NO: 529251 - RNA, 32 nt, Human
ugucucuccuaaaaauacagaaaauuagccug

SEQ ID NO: 529252 - RNA, 32 nt, Human
ugucucuccucggaguuggcggaggcggcaac

SEQ ID NO: 529253 - RNA, 32 nt, Human
ugucucuccuucccucccuuccuucaagauaa

SEQ ID NO: 529254 - RNA, 32 nt, Human
ugucucucuacagacugggagaaagaauugga

SEQ ID NO: 529255 - RNA, 32 nt, Human
ugucucucucauccucuuuuccuuccuucuuu

SEQ ID NO: 529256 - RNA, 32 nt, Human
ugucucucuccucuccucaggcucaauaauuc

SEQ ID NO: 529257 - RNA, 32 nt, Human
ugucucucucgaguacagaccagcacaugguc

SEQ ID NO: 529258 - RNA, 32 nt, Human
ugucucucugcgguaccccauggagcugucuu

SEQ ID NO: 529259 - RNA, 32 nt, Human
ugucucucugcuacagcuucuuggcuggcucu

SEQ ID NO: 529260 - RNA, 31 nt, Human
ugucucucuuaauugguauguugaaaugauu

SEQ ID NO: 529261 - RNA, 32 nt, Human
ugucucucuugucccucguucuccccugaagu

SEQ ID NO: 529262 - RNA, 32 nt, Human
ugucucucuuucucucuuucuuucucuguccc

SEQ ID NO: 529263 - RNA, 32 nt, Human
ugucucucuuuguacugucacucucaucuguu

SEQ ID NO: 529264 - RNA, 32 nt, Human
ugucucugagauaccucucuacucagcccagu

SEQ ID NO: 529265 - RNA, 32 nt, Human
ugucucugaugcucuucuucugugucucuauu

SEQ ID NO: 529266 - RNA, 32 nt, Human
ugucucugcaaaauauacaaaaauuagcuggg

SEQ ID NO: 529267 - RNA, 32 nt, Human
ugucucugcaccugucuguccaucugcaugca

SEQ ID NO: 529268 - RNA, 32 nt, Human
ugucucugcacucuaguuucccugugugggcu

SEQ ID NO: 529269 - RNA, 32 nt, Human
ugucucugcagcguucagcauggcacugucuu

SEQ ID NO: 529270 - RNA, 32 nt, Human
ugucucugccucuggcuauucaaguaccucuc

SEQ ID NO: 529271 - RNA, 32 nt, Human
ugucucugccuggagcaggggugguuucuacg

SEQ ID NO: 529272 - RNA, 32 nt, Human
ugucucugcuaaaaauaagaaaaauuagccag

SEQ ID NO: 529273 - RNA, 22 nt, Human
ugucucugcuaaaaauacaaaa

SEQ ID NO: 529274 - RNA, 32 nt, Human
ugucucugcuaaaaauacaaaaauuagccaga

SEQ ID NO: 529275 - RNA, 32 nt, Human
ugucucugcuaaaaauacaaaaauuagccagg

SEQ ID NO: 529276 - RNA, 23 nt, Human
ugucucugcuaaaaauacaaaau

SEQ ID NO: 529277 - RNA, 32 nt, Human
ugucucugcuaaaaauacaaaauuuagcuggg

SEQ ID NO: 529278 - RNA, 32 nt, Human
ugucucugcucaccaggacguacuucucucua

SEQ ID NO: 529279 - RNA, 32 nt, Human
ugucucugcugacuucagccuggucaugcuug

SEQ ID NO: 529280 - RNA, 32 nt, Human
ugucucuggacucuccccugugaggcccaauu

SEQ ID NO: 529281 - RNA, 32 nt, Human
ugucucuggagugcccuacagccccgcaaacu

SEQ ID NO: 529282 - RNA, 29 nt, Human
ugucucuggcugcccucggccuccaagga

SEQ ID NO: 529283 - RNA, 32 nt, Human
ugucucuggcuucauccuugggccagaaggcu

SEQ ID NO: 529284 - RNA, 32 nt, Human
ugucucuggggguggggugagguuggggcgau

SEQ ID NO: 529285 - RNA, 21 nt, Human
ugucucuggguuuuguucuca

SEQ ID NO: 529286 - RNA, 32 nt, Human
ugucucugguguucucuggcucuuguccaucu

SEQ ID NO: 529287 - RNA, 31 nt, Human
ugucucuguauuuucuuacauuuggaguaug

SEQ ID NO: 529288 - RNA, 32 nt, Human
ugucucugucauaacuugucaacacugcugua

SEQ ID NO: 529289 - RNA, 32 nt, Human
ugucucugucccagacccugugucccccacac

SEQ ID NO: 529290 - RNA, 32 nt, Human
ugucucugucucuccuagccccucucucacac

SEQ ID NO: 529291 - RNA, 32 nt, Human
ugucucugugcuuccuucacuucaccuccauc

SEQ ID NO: 529292 - RNA, 32 nt, Human
ugucucugugggcuugggauguuaacaggagc

SEQ ID NO: 529293 - RNA, 32 nt, Human
ugucucuguggguggucacaggcgggugugag

SEQ ID NO: 529294 - RNA, 32 nt, Human
ugucucuguggguggucacaguagcgugugag

SEQ ID NO: 529295 - RNA, 32 nt, Human
ugucucuguggguggucaccggcgggugugag

SEQ ID NO: 529296 - RNA, 32 nt, Human
ugucucuguggguggucacgggagggugugag

SEQ ID NO: 529297 - RNA, 32 nt, Human
ugucucuguguaugugucugugugucugcguc

SEQ ID NO: 529298 - RNA, 23 nt, Human
ugucucuguuaaaaauacaaaau

SEQ ID NO: 529299 - RNA, 32 nt, Human
ugucucuguuaaaaauacaaaauuagccaggc

SEQ ID NO: 529300 - RNA, 32 nt, Human
ugucucuguucccugcuuuggccaguggcuau

SEQ ID NO: 529301 - RNA, 32 nt, Human
ugucucuguugccugggcuggagugcaguggc

SEQ ID NO: 529302 - RNA, 32 nt, Human
ugucucuguuggaccugucucuccucagucua

SEQ ID NO: 529303 - RNA, 32 nt, Human
ugucucuuaaagcucacuaucucuggccauuc

SEQ ID NO: 529304 - RNA, 32 nt, Human
ugucucuucacacagaggcacaaccuggaccc

SEQ ID NO: 529305 - RNA, 31 nt, Human
ugucucuucaucucugcuccugugucauacu

SEQ ID NO: 529306 - RNA, 22 nt, Human
ugucucuuccaaaaauacaaaa

SEQ ID NO: 529307 - RNA, 32 nt, Human
ugucucuucccuggaaaccuucugcaaagaug

SEQ ID NO: 529308 - RNA, 32 nt, Human
ugucucuucuaaaaauacaaauauuagcuggg

SEQ ID NO: 529309 - RNA, 32 nt, Human
ugucucuugugucuucugcugacugcagauua

SEQ ID NO: 529310 - RNA, 32 nt, Human
ugucucuuguucuccucugaguauccaugugu

SEQ ID NO: 529311 - RNA, 32 nt, Human
ugucucuuucugucagaacugucuucuauuuc

SEQ ID NO: 529312 - RNA, 32 nt, Human
ugucucuuucugucuguuucucugucuuaauc

SEQ ID NO: 529313 - RNA, 32 nt, Human
ugucucuuuuaaaaucuacuguauuuauuaua

SEQ ID NO: 529314 - RNA, 32 nt, Human
ugucucuuuuccccaacugagauaguuucuaa

SEQ ID NO: 529315 - RNA, 32 nt, Human
ugucucuuuuccccuacugagauagcuucuga

SEQ ID NO: 529316 - RNA, 32 nt, Human
ugucugaaauguggcagccacugugggccagg

SEQ ID NO: 529317 - RNA, 32 nt, Human
ugucugaacucaccuggccugggaagcaccgu

SEQ ID NO: 529318 - RNA, 32 nt, Human
ugucugaacugcucuggcugggcauuccugag

SEQ ID NO: 529319 - RNA, 32 nt, Human
ugucugaagaacgccaggcugguguccccaga

SEQ ID NO: 529320 - RNA, 32 nt, Human
ugucugaagagauggcaccagggaaaggugug

SEQ ID NO: 529321 - RNA, 32 nt, Human
ugucugaagagggagaugagacagcucucugg

SEQ ID NO: 529322 - RNA, 32 nt, Human
ugucugacaucccacacacaucggcacacuug

SEQ ID NO: 529323 - RNA, 32 nt, Human
ugucugaccacugcagaccagucucggaggug

SEQ ID NO: 529324 - RNA, 32 nt, Human
ugucugacucuuccucuuccuccugcucccug

SEQ ID NO: 529325 - RNA, 32 nt, Human
ugucugagacucuggcuuauuccagguuggcu

SEQ ID NO: 529326 - RNA, 32 nt, Human
ugucugagcaggcagaccagaagaccaggcac

SEQ ID NO: 529327 - RNA, 32 nt, Human
ugucugagcccagccaccugaguuuuuaguac

SEQ ID NO: 529328 - RNA, 21 nt, Human
ugucugagcggagcuuugcgg

SEQ ID NO: 529329 - RNA, 32 nt, Human
ugucugagcucccuuugucauugacguuguaa

SEQ ID NO: 529330 - RNA, 32 nt, Human
ugucugaggaagggagagggagggccuggggu

SEQ ID NO: 529331 - RNA, 32 nt, Human
ugucugagguagcuugaccugcuuucaccugg

SEQ ID NO: 529332 - RNA, 32 nt, Human
ugucugagucaugaagaaauggagauuacuga

SEQ ID NO: 529333 - RNA, 32 nt, Human
ugucugagucugugugggagucagcgaugcuu

SEQ ID NO: 529334 - RNA, 32 nt, Human
ugucugagugagugaaacuacaagagguaaaa

SEQ ID NO: 529335 - RNA, 32 nt, Human
ugucugaguggguggucacgggagggugugug

SEQ ID NO: 529336 - RNA, 21 nt, Human
ugucugaguguugucuggaga

SEQ ID NO: 529337 - RNA, 21 nt, Human
ugucugaucaucagauccugu

SEQ ID NO: 529338 - RNA, 32 nt, Human
ugucugaugcugcucccuucuauccaacauuc

SEQ ID NO: 529339 - RNA, 32 nt, Human
ugucugauuccccuagccgccaccccacguuu

SEQ ID NO: 529340 - RNA, 32 nt, Human
ugucugcaaggagaauacacagcagcgagggg

SEQ ID NO: 529341 - RNA, 32 nt, Human
ugucugcacaaacucuggucuguuuugcacgg

SEQ ID NO: 529342 - RNA, 32 nt, Human
ugucugcacaccaucucccaccagccuccccu

SEQ ID NO: 529343 - RNA, 32 nt, Human
ugucugcaccagccggccucagccuggcugga

SEQ ID NO: 529344 - RNA, 32 nt, Human
ugucugcacccagggguggggaauguuugggc

SEQ ID NO: 529345 - RNA, 32 nt, Human
ugucugcaccuccuuucccucucuccaucuuc

SEQ ID NO: 529346 - RNA, 32 nt, Human
ugucugcaccugugaccaucaggaugagcugg

SEQ ID NO: 529347 - RNA, 32 nt, Human
ugucugcagcacccuccacuucucuccuaggc

SEQ ID NO: 529348 - RNA, 32 nt, Human
ugucugcagcagagugacagcaguggagauug

SEQ ID NO: 529349 - RNA, 32 nt, Human
ugucugcagccgaggagacaacuacaaacaga

SEQ ID NO: 529350 - RNA, 32 nt, Human
ugucugcagccucugcucacuccaggacgugc

SEQ ID NO: 529351 - RNA, 21 nt, Human
ugucugcagggcucccucuac

SEQ ID NO: 529352 - RNA, 32 nt, Human
ugucugcagggcuggccucccacagcagugug

SEQ ID NO: 529353 - RNA, 32 nt, Human
ugucugcaguaggaaggaaagaggcuaaucuc

SEQ ID NO: 529354 - RNA, 32 nt, Human
ugucugcaugaucuaucccagacugaaaagag

SEQ ID NO: 529355 - RNA, 32 nt, Human
ugucugcauuaaaaauacuagagauuaggcca

SEQ ID NO: 529356 - RNA, 32 nt, Human
ugucugcauuuuaccauagauuggagugcauc

SEQ ID NO: 529357 - RNA, 32 nt, Human
ugucugccaaucuggguaggcccaguggccaa

SEQ ID NO: 529358 - RNA, 32 nt, Human
ugucugccaccaaaggugaccaccaugucggu

SEQ ID NO: 529359 - RNA, 32 nt, Human
ugucugccacgcgcagccccuugugcgggauc

SEQ ID NO: 529360 - RNA, 21 nt, Human
ugucugccagccucccaggcc

SEQ ID NO: 529361 - RNA, 32 nt, Human
ugucugccaguggaguccauguuuccaccacu

SEQ ID NO: 529362 - RNA, 32 nt, Human
ugucugccaugcgcuucuuccucccaggcuac

SEQ ID NO: 529363 - RNA, 32 nt, Human
ugucugcccaccacccuucuuucugaacgugg

SEQ ID NO: 529364 - RNA, 19 nt, Human
ugucugcccauguccugcu

SEQ ID NO: 529365 - RNA, 32 nt, Human
ugucugccccggccaaggaguuugucaaggug

SEQ ID NO: 529366 - RNA, 32 nt, Human
ugucugcccuaaaagacaguaaguaggaauau

SEQ ID NO: 529367 - RNA, 32 nt, Human
ugucugcccuaaaagauaguaaguaggaauau

SEQ ID NO: 529368 - RNA, 32 nt, Human
ugucugcccuacugcuuccugcagcuggccua

SEQ ID NO: 529369 - RNA, 32 nt, Human
ugucugcccugagaugcucgcucuccugcugg

SEQ ID NO: 529370 - RNA, 32 nt, Human
ugucugccgggggcccaggcugugcugucccu

SEQ ID NO: 529371 - RNA, 32 nt, Human
ugucugccucccaggcucugcagaccguggcc

SEQ ID NO: 529372 - RNA, 32 nt, Human
ugucugccugaggagggaaagggggaguggcc

SEQ ID NO: 529373 - RNA, 32 nt, Human
ugucugccugggauaaaauauuuuccccaucu

SEQ ID NO: 529374 - RNA, 32 nt, Human
ugucugccuguucuccccucgucgguggcuaa

SEQ ID NO: 529375 - RNA, 32 nt, Human
ugucugccuucaguggucugaggucccaguau

SEQ ID NO: 529376 - RNA, 32 nt, Human
ugucugccuuucuucugcuugggcucuucaag

SEQ ID NO: 529377 - RNA, 20 nt, Human
ugucugcgccugcccuccgc

SEQ ID NO: 529378 - RNA, 32 nt, Human
ugucugcuaucaaaccacuucugacaaaauua

SEQ ID NO: 529379 - RNA, 32 nt, Human
ugucugcuaucagcuaugccgcugcccguugc

SEQ ID NO: 529380 - RNA, 32 nt, Human
ugucugcucacugcugccaucuucgcugcuag

SEQ ID NO: 529381 - RNA, 32 nt, Human
ugucugcucaugggagaauggcagagggaucc

SEQ ID NO: 529382 - RNA, 32 nt, Human
ugucugcuccgggucucuaccuggucuccauc

SEQ ID NO: 529383 - RNA, 32 nt, Human
ugucugcucucuggaccccacgugaucuggcc

SEQ ID NO: 529384 - RNA, 32 nt, Human
ugucugcugcagcuuccgugccccguucuccu

SEQ ID NO: 529385 - RNA, 32 nt, Human
ugucugcugccuggcuccuagauggcucugcg

SEQ ID NO: 529386 - RNA, 32 nt, Human
ugucugcugcucccucuccucagccaguuggg

SEQ ID NO: 529387 - RNA, 32 nt, Human
ugucugcugcugcuguccgagcuucacaaugc

SEQ ID NO: 529388 - RNA, 32 nt, Human
ugucugcugcuggcucugcccuguggccguga

SEQ ID NO: 529389 - RNA, 32 nt, Human
ugucugcugggcugcacuggggcuguucaugg

SEQ ID NO: 529390 - RNA, 32 nt, Human
ugucugcugugggugcgguggugaggaguggc

SEQ ID NO: 529391 - RNA, 32 nt, Human
ugucugcuguuuagaacuuuguggacugcacu

SEQ ID NO: 529392 - RNA, 32 nt, Human
ugucugcuucuacuacuccaucaaggucaacu

SEQ ID NO: 529393 - RNA, 32 nt, Human
ugucugcuuguuugcgacagagcgagacuccg

SEQ ID NO: 529394 - RNA, 32 nt, Human
ugucuggaacaguggaccaaugcuggggacca

SEQ ID NO: 529395 - RNA, 23 nt, Human
ugucuggaaggugaaaaccaagg

SEQ ID NO: 529396 - RNA, 32 nt, Human
ugucuggacacccggccccagcuccagcccca

SEQ ID NO: 529397 - RNA, 32 nt, Human
ugucuggaccugggcccugcucaaugccaccu

SEQ ID NO: 529398 - RNA, 32 nt, Human
ugucuggagccguagcggcaagugggcuugcg

SEQ ID NO: 529399 - RNA, 32 nt, Human
ugucuggaggaggccugcaucccuccugagcu

SEQ ID NO: 529400 - RNA, 32 nt, Human
ugucuggagggccauggagaagaggcugggag

SEQ ID NO: 529401 - RNA, 32 nt, Human
ugucuggaggggcaguguacaggugcucuauu

SEQ ID NO: 529402 - RNA, 32 nt, Human
ugucuggagucuuuugccaucuggaucuuagu

SEQ ID NO: 529403 - RNA, 31 nt, Human
ugucuggauucugccucuugccaaagcagag

SEQ ID NO: 529404 - RNA, 32 nt, Human
ugucuggcacauguucuguaauccaagauguc

SEQ ID NO: 529405 - RNA, 32 nt, Human
ugucuggcagaagaaauuucuaagcagcgaaa

SEQ ID NO: 529406 - RNA, 21 nt, Human
ugucuggcagagaccugugga

SEQ ID NO: 529407 - RNA, 32 nt, Human
ugucuggccagcugcccacgaccuacggugua

SEQ ID NO: 529408 - RNA, 22 nt, Human
ugucuggcccccacccacugcc

SEQ ID NO: 529409 - RNA, 32 nt, Human
ugucuggccuuuugucucauccuucuuggcaa

SEQ ID NO: 529410 - RNA, 22 nt, Human
ugucuggcgcauccucagugga

SEQ ID NO: 529411 - RNA, 32 nt, Human
ugucuggcuccagcccuuucucugugccuuca

SEQ ID NO: 529412 - RNA, 32 nt, Human
ugucuggcuggcuccguccgugugacagccca

SEQ ID NO: 529413 - RNA, 32 nt, Human
ugucuggcuggguggaagaaggguguggaagg

SEQ ID NO: 529414 - RNA, 32 nt, Human
ugucuggcuucucucuggacugggagcucagu

SEQ ID NO: 529415 - RNA, 32 nt, Human
ugucugggaaccugggcaggaggcacagagga

SEQ ID NO: 529416 - RNA, 32 nt, Human
ugucugggaacugccucccucaucugugcccc

SEQ ID NO: 529417 - RNA, 32 nt, Human
ugucugggaagcagggauugcugacauguauu

SEQ ID NO: 529418 - RNA, 32 nt, Human
ugucugggacucaggaguccuaaggaaaagga

SEQ ID NO: 529419 - RNA, 32 nt, Human
ugucugggagagaggauaggaugggaaugcug

SEQ ID NO: 529420 - RNA, 32 nt, Human
ugucugggcugcagggacauugcaguguccca

SEQ ID NO: 529421 - RNA, 32 nt, Human
ugucugggcugcucccgcugcacccagcggcu

SEQ ID NO: 529422 - RNA, 32 nt, Human
ugucuggggaaaggugggccuggcagaagaca

SEQ ID NO: 529423 - RNA, 32 nt, Human
ugucugggggauaacagugcucucuuaccuca

SEQ ID NO: 529424 - RNA, 32 nt, Human
ugucugggggccucucugggccuuugugugcc

SEQ ID NO: 529425 - RNA, 32 nt, Human
ugucugggguauucacuuggcuccucagcaag

SEQ ID NO: 529426 - RNA, 32 nt, Human
ugucuggggugaauggaaugagcuggagcuug

SEQ ID NO: 529427 - RNA, 32 nt, Human
ugucuggggugcugugcacccccuggagccug

SEQ ID NO: 529428 - RNA, 16 nt, Human
ugucugggucuggaga

SEQ ID NO: 529429 - RNA, 32 nt, Human
ugucuggugaucacuuuaugucucacagggac

SEQ ID NO: 529430 - RNA, 32 nt, Human
ugucuggugaugaugucuuucauggcaucuga

SEQ ID NO: 529431 - RNA, 32 nt, Human
ugucuggugauuuucugccugguggggccauu

SEQ ID NO: 529432 - RNA, 22 nt, Human
ugucuggugcccaaucccagga

SEQ ID NO: 529433 - RNA, 32 nt, Human
ugucugguugcccugccucuggcuccagaaca

SEQ ID NO: 529434 - RNA, 32 nt, Human
ugucuguaaagugcuuugaggaucuccccagc

SEQ ID NO: 529435 - RNA, 32 nt, Human
ugucuguacagccucuaggccccagccccgga

SEQ ID NO: 529436 - RNA, 32 nt, Human
ugucuguaccaaaaauacaaaaaguuagcugg

SEQ ID NO: 529437 - RNA, 32 nt, Human
ugucuguaccaaaaauacaaaaauuaauuggg

SEQ ID NO: 529438 - RNA, 22 nt, Human
ugucuguacuaaaaauacaaaa

SEQ ID NO: 529439 - RNA, 32 nt, Human
ugucuguacuaaaaauacaaaaaucagccaga

SEQ ID NO: 529440 - RNA, 32 nt, Human
ugucuguacuaaaaauacaaaaauuaacuggg

SEQ ID NO: 529441 - RNA, 32 nt, Human
ugucuguacuaaaaauacaaaaauuagccaga

SEQ ID NO: 529442 - RNA, 32 nt, Human
ugucuguacuaaaaauacaaaaauuagccagg

SEQ ID NO: 529443 - RNA, 32 nt, Human
ugucuguacuaaaaauacaaaaauuagcccag

SEQ ID NO: 529444 - RNA, 32 nt, Human
ugucuguacuaaaaauacaaaaauuagccggg

SEQ ID NO: 529445 - RNA, 32 nt, Human
ugucuguacuaaaaauacaaaaguuagcugag

SEQ ID NO: 529446 - RNA, 23 nt, Human
ugucuguacuaaaaauacaaaau

SEQ ID NO: 529447 - RNA, 32 nt, Human
ugucuguacuaaaaauacaaaauuuagccagg

SEQ ID NO: 529448 - RNA, 32 nt, Human
ugucuguacuaaaaauacagaauuagccgggc

SEQ ID NO: 529449 - RNA, 32 nt, Human
ugucuguacuaaaaaugcaaaaauuagcuggg

SEQ ID NO: 529450 - RNA, 32 nt, Human
ugucuguacuaaaauacaaaaaucagccaggc

SEQ ID NO: 529451 - RNA, 32 nt, Human
ugucuguacuucuguuugaacuuuccacguug

SEQ ID NO: 529452 - RNA, 32 nt, Human
ugucuguagaagaugcuuccuccauuaaacug

SEQ ID NO: 529453 - RNA, 32 nt, Human
ugucuguagggcugggacagggaaggaaguca

SEQ ID NO: 529454 - RNA, 32 nt, Human
ugucuguaggugucucugggccuguguguggg

SEQ ID NO: 529455 - RNA, 22 nt, Human
ugucuguaguaaaaauacaaaa

SEQ ID NO: 529456 - RNA, 32 nt, Human
ugucuguaguaaaaauacaaaaauuagcuggg

SEQ ID NO: 529457 - RNA, 32 nt, Human
ugucuguaguuucuuuauuaagcucugaaaac

SEQ ID NO: 529458 - RNA, 32 nt, Human
ugucuguauccccagugcccggugcagggccu

SEQ ID NO: 529459 - RNA, 32 nt, Human
ugucuguauguuuguguacacacacgugccca

SEQ ID NO: 529460 - RNA, 24 nt, Human
ugucugucaaggaucuuugucgug

SEQ ID NO: 529461 - RNA, 32 nt, Human
ugucugucaaucucccuucuugcugauuagcu

SEQ ID NO: 529462 - RNA, 32 nt, Human
ugucugucacauuaguagauucugagauuaaa

SEQ ID NO: 529463 - RNA, 32 nt, Human
ugucugucacccaggcuggaguacaguggcau

SEQ ID NO: 529464 - RNA, 32 nt, Human
ugucugucagacacacacaggucgccagugac

SEQ ID NO: 529465 - RNA, 32 nt, Human
ugucugucagcccucuuaacucugugcacgcc

SEQ ID NO: 529466 - RNA, 22 nt, Human
ugucugucagugaccuucugua

SEQ ID NO: 529467 - RNA, 32 nt, Human
ugucugucauacgcuaaaaugauauuggucuu

SEQ ID NO: 529468 - RNA, 32 nt, Human
ugucugucaugagugcaugaaggaggccaaga

SEQ ID NO: 529469 - RNA, 32 nt, Human
ugucugucccacccugauccuuuucaauauau

SEQ ID NO: 529470 - RNA, 32 nt, Human
ugucugucccucacagcaccaaauguucccug

SEQ ID NO: 529471 - RNA, 32 nt, Human
ugucugucccugacuucugccucugagauugu

SEQ ID NO: 529472 - RNA, 32 nt, Human
ugucuguccggccugcacccagccccugccca

SEQ ID NO: 529473 - RNA, 31 nt, Human
ugucuguccgucucugggaauggucgcuucc

SEQ ID NO: 529474 - RNA, 19 nt, Human
ugucuguccuggguguaga

SEQ ID NO: 529475 - RNA, 24 nt, Human
ugucuguccuugugauuuggcaua

SEQ ID NO: 529476 - RNA, 32 nt, Human
ugucuguccuuuuccuccuuggagccugggcc

SEQ ID NO: 529477 - RNA, 32 nt, Human
ugucugucgcugcugccgccuccacccagccu

SEQ ID NO: 529478 - RNA, 32 nt, Human
ugucugucucccacccucacugaucacgccug

SEQ ID NO: 529479 - RNA, 32 nt, Human
ugucugucuccugcccacaucucccuuccuuc

SEQ ID NO: 529480 - RNA, 32 nt, Human
ugucugucucuaguuucuuucuguuauugcac

SEQ ID NO: 529481 - RNA, 32 nt, Human
ugucugucucugucuguugcucgaauaacucu

SEQ ID NO: 529482 - RNA, 32 nt, Human
ugucugucugacgacaucucuccuggggucug

SEQ ID NO: 529483 - RNA, 32 nt, Human
ugucugucugagucucguggccgccccuggac

SEQ ID NO: 529484 - RNA, 32 nt, Human
ugucugucugcugccaggauggagcagaggag

SEQ ID NO: 529485 - RNA, 32 nt, Human
ugucugucugggaggauggggcaguaaaugag

SEQ ID NO: 529486 - RNA, 25 nt, Human
ugucugucugguccauagcuguggu

SEQ ID NO: 529487 - RNA, 32 nt, Human
ugucugucugucugucccucccucucugaacc

SEQ ID NO: 529488 - RNA, 32 nt, Human
ugucugucuugaugugugagcagcagcugugg

SEQ ID NO: 529489 - RNA, 32 nt, Human
ugucugucuuucuccuauccuuugugucuuug

SEQ ID NO: 529490 - RNA, 32 nt, Human
ugucugugaaacugguacaaccugccauaaga

SEQ ID NO: 529491 - RNA, 23 nt, Human
ugucugugaagacuuccuggaga

SEQ ID NO: 529492 - RNA, 32 nt, Human
ugucugugacucgcucuggaccccacuucccg

SEQ ID NO: 529493 - RNA, 32 nt, Human
ugucugugagccaguuccagcuggcuccagcc

SEQ ID NO: 529494 - RNA, 32 nt, Human
ugucugugcauccugaaccacucuuugcuggg

SEQ ID NO: 529495 - RNA, 32 nt, Human
ugucugugcauucaugcaucuaccucauuccg

SEQ ID NO: 529496 - RNA, 32 nt, Human
ugucugugccauaacacaguacuagaccacuu

SEQ ID NO: 529497 - RNA, 32 nt, Human
ugucugugcccaagcccuuccaccagaaaagc

SEQ ID NO: 529498 - RNA, 32 nt, Human
ugucugugccuagugaauuucccuuacauuuc

SEQ ID NO: 529499 - RNA, 32 nt, Human
ugucugugccugggagaacagagcaggagcgu

SEQ ID NO: 529500 - RNA, 32 nt, Human
ugucugugcguucuccugcguggcaguccuga

SEQ ID NO: 529501 - RNA, 32 nt, Human
ugucugugcucacccaggcugagggugccuuu

SEQ ID NO: 529502 - RNA, 20 nt, Human
ugucugugcuggcuggaaga

SEQ ID NO: 529503 - RNA, 17 nt, Human
ugucuguggauuggaga

SEQ ID NO: 529504 - RNA, 32 nt, Human
ugucugugggaggcgccggggugauggcggug

SEQ ID NO: 529505 - RNA, 19 nt, Human
ugucuguggggaccugaga

SEQ ID NO: 529506 - RNA, 32 nt, Human
ugucuguggggagggguuguuuugggguuguu

SEQ ID NO: 529507 - RNA, 32 nt, Human
ugucuguggucugccaaauacuugcuuaaacu

SEQ ID NO: 529508 - RNA, 32 nt, Human
ugucuguggugccauuugauucccugacacug

SEQ ID NO: 529509 - RNA, 32 nt, Human
ugucugugucccauccugcuguccuucugucc

SEQ ID NO: 529510 - RNA, 18 nt, Human
ugucuguguccucggagg

SEQ ID NO: 529511 - RNA, 32 nt, Human
ugucugugucuccagugcucccauuccaucgc

SEQ ID NO: 529512 - RNA, 32 nt, Human
ugucugugucuccucuucugucucuuagaagg

SEQ ID NO: 529513 - RNA, 32 nt, Human
ugucugugucugcacugcuccccaggauguuc

SEQ ID NO: 529514 - RNA, 29 nt, Human
ugucugugucugugugugccugugagcca

SEQ ID NO: 529515 - RNA, 32 nt, Human
ugucugugugcagccuaugccugcugcucaga

SEQ ID NO: 529516 - RNA, 32 nt, Human
ugucuguguggcuuucccucccugccuccccc

SEQ ID NO: 529517 - RNA, 32 nt, Human
ugucuguguggguggucacagaagggugugug

SEQ ID NO: 529518 - RNA, 32 nt, Human
ugucuguguggguggucacaggagggugugag

SEQ ID NO: 529519 - RNA, 32 nt, Human
ugucuguguggguggucacaggagggugugug

SEQ ID NO: 529520 - RNA, 32 nt, Human
ugucuguguggguggucacgggagcgugugag

SEQ ID NO: 529521 - RNA, 32 nt, Human
ugucuguguggguggucacgggagggugugag

SEQ ID NO: 529522 - RNA, 32 nt, Human
ugucuguguggguggucacgggagggugugug

SEQ ID NO: 529523 - RNA, 32 nt, Human
ugucuguguguaugcauacauauguguguaua

SEQ ID NO: 529524 - RNA, 32 nt, Human
ugucuguguguauguuagucugucaacuucgg

SEQ ID NO: 529525 - RNA, 17 nt, Human
ugucugugugucuguga

SEQ ID NO: 529526 - RNA, 32 nt, Human
ugucugugugugugcacgcgcgugcacgucac

SEQ ID NO: 529527 - RNA, 32 nt, Human
ugucugugugugugcaugugcacacauguguu

SEQ ID NO: 529528 - RNA, 17 nt, Human
ugucuguguguuugaga

SEQ ID NO: 529529 - RNA, 32 nt, Human
ugucuguguuccaaauccaccaauugacgaga

SEQ ID NO: 529530 - RNA, 17 nt, Human
ugucuguguucuuggag

SEQ ID NO: 529531 - RNA, 19 nt, Human
ugucuguguuuguuugaga

SEQ ID NO: 529532 - RNA, 22 nt, Human
ugucuguuaaaugaaugucaua

SEQ ID NO: 529533 - RNA, 24 nt, Human
ugucuguuaaguggucuuuucaua

SEQ ID NO: 529534 - RNA, 32 nt, Human
ugucuguuauagaaaacccacacccacugucc

SEQ ID NO: 529535 - RNA, 32 nt, Human
ugucuguuccagccuacauccuuccugggugu

SEQ ID NO: 529536 - RNA, 17 nt, Human
ugucuguucccuggagg

SEQ ID NO: 529537 - RNA, 32 nt, Human
ugucuguucccuggaggccaguccagugcuca

SEQ ID NO: 529538 - RNA, 32 nt, Human
ugucuguuccuauuccauucucccaggagcuu

SEQ ID NO: 529539 - RNA, 32 nt, Human
ugucuguucuaauauugggacuucugauuaug

SEQ ID NO: 529540 - RNA, 32 nt, Human
ugucuguucuucagugcuggagguccuggcag

SEQ ID NO: 529541 - RNA, 32 nt, Human
ugucuguugcucacagaugcagagacugacaa

SEQ ID NO: 529542 - RNA, 32 nt, Human
ugucuguuuacacuucucuguaggcguggguu

SEQ ID NO: 529543 - RNA, 22 nt, Human
ugucuguuuccccauccugcca

SEQ ID NO: 529544 - RNA, 32 nt, Human
ugucuguuuuugaaagguguugcuuucaagua

SEQ ID NO: 529545 - RNA, 32 nt, Human
ugucuuaaauaacauuuauuucucacaguccu

SEQ ID NO: 529546 - RNA, 32 nt, Human
ugucuuaaauguauacauuagauguguguuuu

SEQ ID NO: 529547 - RNA, 29 nt, Human
ugucuuaauaaauauuuuaucaaaauguc

SEQ ID NO: 529548 - RNA, 32 nt, Human
ugucuuacagagaagagaagagggagucagcc

SEQ ID NO: 529549 - RNA, 32 nt, Human
ugucuuacaucuccauuuuauagaugagaaag

SEQ ID NO: 529550 - RNA, 32 nt, Human
ugucuuacauugaagcacagacugcagagcac

SEQ ID NO: 529551 - RNA, 32 nt, Human
ugucuuaccagcauuucuucugggcuugugau

SEQ ID NO: 529552 - RNA, 32 nt, Human
ugucuuaccucuacugaauauucuagugaguu

SEQ ID NO: 529553 - RNA, 32 nt, Human
ugucuuaccuuucuccccuagugcucaugccc

SEQ ID NO: 529554 - RNA, 32 nt, Human
ugucuuacugugcuucaacuucccaaggaauu

SEQ ID NO: 529555 - RNA, 32 nt, Human
ugucuuagagcagcaauucauuaucagaggga

SEQ ID NO: 529556 - RNA, 21 nt, Human
ugucuuagcccaagguguaga

SEQ ID NO: 529557 - RNA, 32 nt, Human
ugucuuagcuacucaggaggcugaggcaggag

SEQ ID NO: 529558 - RNA, 32 nt, Human
ugucuuagggugcucccugugacagauccugg

SEQ ID NO: 529559 - RNA, 32 nt, Human
ugucuuagucaaggugcugcagaaggacagaa

SEQ ID NO: 529560 - RNA, 32 nt, Human
ugucuuauagguuuacacugccaaaacaaugc

SEQ ID NO: 529561 - RNA, 32 nt, Human
ugucuuauggcugggugcaguggcucaugccc

SEQ ID NO: 529562 - RNA, 32 nt, Human
ugucuuaugucagcugggcacaguggcucaca

SEQ ID NO: 529563 - RNA, 32 nt, Human
ugucuuauuaaaucuucacuguauuuaaugca

SEQ ID NO: 529564 - RNA, 32 nt, Human
ugucuucaacaacaggugcugcuuagucauuu

SEQ ID NO: 529565 - RNA, 32 nt, Human
ugucuucaacaucauuugauacuauagacuua

SEQ ID NO: 529566 - RNA, 32 nt, Human
ugucuucacugagguccucgcgcucagaaaag

SEQ ID NO: 529567 - RNA, 32 nt, Human
ugucuucacugccuccuuuucccugucaugcu

SEQ ID NO: 529568 - RNA, 32 nt, Human
ugucuucacugcucuguguccucugcuccuag

SEQ ID NO: 529569 - RNA, 32 nt, Human
ugucuucacugcuguguguccucugcuccuag

SEQ ID NO: 529570 - RNA, 32 nt, Human
ugucuucagcacaaaacaccuucaauguucug

SEQ ID NO: 529571 - RNA, 32 nt, Human
ugucuucaguaaaauauuuucuuuaucuaaau

SEQ ID NO: 529572 - RNA, 32 nt, Human
ugucuucaguagcgacugaaucugccacucuc

SEQ ID NO: 529573 - RNA, 32 nt, Human
ugucuucagugcaauguggcauccuggauugg

SEQ ID NO: 529574 - RNA, 32 nt, Human
ugucuucaugccaaccacagccuguuucugcu

SEQ ID NO: 529575 - RNA, 32 nt, Human
ugucuucaugucguuguucugccuuucacaaa

SEQ ID NO: 529576 - RNA, 28 nt, Human
ugucuuccaagugccauccaucaucagu

SEQ ID NO: 529577 - RNA, 32 nt, Human
ugucuuccacacccuuccucccuccaggcucc

SEQ ID NO: 529578 - RNA, 32 nt, Human
ugucuuccagcuugcccugccuccagcaggaa

SEQ ID NO: 529579 - RNA, 23 nt, Human
ugucuuccaggcuggagugcagu

SEQ ID NO: 529580 - RNA, 24 nt, Human
ugucuuccaggcuggagugcagug

SEQ ID NO: 529581 - RNA, 32 nt, Human
ugucuuccauggagccucaggugcucccccuc

SEQ ID NO: 529582 - RNA, 21 nt, Human
ugucuucccaccugugugucc

SEQ ID NO: 529583 - RNA, 32 nt, Human
ugucuucccacuuuaagcuuguuuucaguaca

SEQ ID NO: 529584 - RNA, 23 nt, Human
ugucuucccaguggcuuuccaug

SEQ ID NO: 529585 - RNA, 22 nt, Human
ugucuucccaguguccuuggag

SEQ ID NO: 529586 - RNA, 22 nt, Human
ugucuuccccacccagcucucc

SEQ ID NO: 529587 - RNA, 32 nt, Human
ugucuuccccacccucaccuccaucccaucaa

SEQ ID NO: 529588 - RNA, 32 nt, Human
ugucuuccccuggaacugggcacuggcguaca

SEQ ID NO: 529589 - RNA, 23 nt, Human
ugucuucccgguaucccuuggag

SEQ ID NO: 529590 - RNA, 23 nt, Human
ugucuucccgugugucuucagga

SEQ ID NO: 529591 - RNA, 32 nt, Human
ugucuucccuaacauagccugggagaccaccc

SEQ ID NO: 529592 - RNA, 24 nt, Human
ugucuucccugggccacauuggaa

SEQ ID NO: 529593 - RNA, 32 nt, Human
ugucuuccucaagcaguuuaggugcaugaucu

SEQ ID NO: 529594 - RNA, 32 nt, Human
ugucuuccucagaccccagcucccucuugccc

SEQ ID NO: 529595 - RNA, 32 nt, Human
ugucuuccuccaaccucccccuuuuucguugu

SEQ ID NO: 529596 - RNA, 32 nt, Human
ugucuuccucucccuucuccucugcugcagca

SEQ ID NO: 529597 - RNA, 32 nt, Human
ugucuuccucugucuuccuuuuuacuuccuuu

SEQ ID NO: 529598 - RNA, 32 nt, Human
ugucuuccugacuccagccucugagacagaau

SEQ ID NO: 529599 - RNA, 32 nt, Human
ugucuuccuuccaacucuuaaacauuuuuguu

SEQ ID NO: 529600 - RNA, 32 nt, Human
ugucuuccuugggggaggagauggugucguuu

SEQ ID NO: 529601 - RNA, 32 nt, Human
ugucuuccuuucuccccuuuggaugguuggug

SEQ ID NO: 529602 - RNA, 32 nt, Human
ugucuuccuuucucucuucccuuccccucucu

SEQ ID NO: 529603 - RNA, 17 nt, Human
ugucuucgcggaagcau

SEQ ID NO: 529604 - RNA, 32 nt, Human
ugucuucucaagaacaaaacugugcuguuaca

SEQ ID NO: 529605 - RNA, 32 nt, Human
ugucuucucccaggucucucuuggguacugcc

SEQ ID NO: 529606 - RNA, 32 nt, Human
ugucuucuccccuaggugguuccugagccccc

SEQ ID NO: 529607 - RNA, 32 nt, Human
ugucuucucugucaucgagauggucuucaucg

SEQ ID NO: 529608 - RNA, 32 nt, Human
ugucuucucugucucagacuuuuguacaucug

SEQ ID NO: 529609 - RNA, 32 nt, Human
ugucuucucuuccuccuccaccgagucgugcu

SEQ ID NO: 529610 - RNA, 32 nt, Human
ugucuucucuugaacugcauaacugagaacuc

SEQ ID NO: 529611 - RNA, 32 nt, Human
ugucuucucuuuccucugcccuucccacaggg

SEQ ID NO: 529612 - RNA, 32 nt, Human
ugucuucugccucucucucguuucuuccccca

SEQ ID NO: 529613 - RNA, 32 nt, Human
ugucuucugccuggucuauagcguguguguuu

SEQ ID NO: 529614 - RNA, 18 nt, Human
ugucuucugcuguaauua

SEQ ID NO: 529615 - RNA, 32 nt, Human
ugucuucuggaaaaucauggauuuucauauuu

SEQ ID NO: 529616 - RNA, 32 nt, Human
ugucuucugggacuggacauuuugacuccaag

SEQ ID NO: 529617 - RNA, 32 nt, Human
ugucuucugggugacagacaaaauagcuuguc

SEQ ID NO: 529618 - RNA, 32 nt, Human
ugucuucuguccccaucuuccugccgauagcu

SEQ ID NO: 529619 - RNA, 32 nt, Human
ugucuucugucuuuacccagagcuaccaugag

SEQ ID NO: 529620 - RNA, 32 nt, Human
ugucuucuuuccuccaaccucuuaccuuagau

SEQ ID NO: 529621 - RNA, 32 nt, Human
ugucuucuuugaucauuugauuuuggauccaa

SEQ ID NO: 529622 - RNA, 32 nt, Human
ugucuucuuugcaauaggcagcuugacugcag

SEQ ID NO: 529623 - RNA, 32 nt, Human
ugucuugaacagcuggagggaagaugcagggg

SEQ ID NO: 529624 - RNA, 32 nt, Human
ugucuugaaccuaggagguggagguugcagug

SEQ ID NO: 529625 - RNA, 32 nt, Human
ugucuugagacagggucuggcucuguuggcag

SEQ ID NO: 529626 - RNA, 32 nt, Human
ugucuugagguugucagcaggugcaagacacg

SEQ ID NO: 529627 - RNA, 32 nt, Human
ugucuugauuuuugccuuuucgaugccauauu

SEQ ID NO: 529628 - RNA, 32 nt, Human
ugucuugcaguucagauuaugcagccaagggu

SEQ ID NO: 529629 - RNA, 32 nt, Human
ugucuugccaggaguuaagcggccucuggggu

SEQ ID NO: 529630 - RNA, 32 nt, Human
ugucuugccaucaacccuccccagacccccag

SEQ ID NO: 529631 - RNA, 32 nt, Human
ugucuugcccaaggucacacagcuggugugug

SEQ ID NO: 529632 - RNA, 25 nt, Human
ugucuugcccaggcuggagugcagu

SEQ ID NO: 529633 - RNA, 32 nt, Human
ugucuugcccaggcuggagugcaguggccuga

SEQ ID NO: 529634 - RNA, 32 nt, Human
ugucuugcccaggcuggaguucaggggcuauu

SEQ ID NO: 529635 - RNA, 32 nt, Human
ugucuugccuccaggaccugggaagggugaug

SEQ ID NO: 529636 - RNA, 32 nt, Human
ugucuugccuguauaaagccuuuugguccucu

SEQ ID NO: 529637 - RNA, 32 nt, Human
ugucuugcgagaaguaagaagauggaaaagga

SEQ ID NO: 529638 - RNA, 32 nt, Human
ugucuugcgccuguacucccagcacuuuggga

SEQ ID NO: 529639 - RNA, 32 nt, Human
ugucuugcucacucuuaaacucucccaagaac

SEQ ID NO: 529640 - RNA, 32 nt, Human
ugucuugcucuccccuccccuggcuuuccucu

SEQ ID NO: 529641 - RNA, 32 nt, Human
ugucuugcugggagggucugcaggagaaccgc

SEQ ID NO: 529642 - RNA, 32 nt, Human
ugucuugcugugugaugcucagccugaggcac

SEQ ID NO: 529643 - RNA, 32 nt, Human
ugucuugcuucaugauuccucucuccauuacu

SEQ ID NO: 529644 - RNA, 32 nt, Human
ugucuuggaaaugacuagagaggcagaggaga

SEQ ID NO: 529645 - RNA, 32 nt, Human
ugucuuggauccucagugcugccaaaaggcca

SEQ ID NO: 529646 - RNA, 32 nt, Human
ugucuuggauuccuuagccccuugccaguccu

SEQ ID NO: 529647 - RNA, 32 nt, Human
ugucuuggcacuggccaggcuuggguggagcc

SEQ ID NO: 529648 - RNA, 32 nt, Human
ugucuuggcaucuucugccuuugcuacugagc

SEQ ID NO: 529649 - RNA, 32 nt, Human
ugucuuggccacuccuagagcgugugcagacu

SEQ ID NO: 529650 - RNA, 32 nt, Human
ugucuugggaaagaugaagacgaaaaacagga

SEQ ID NO: 529651 - RNA, 32 nt, Human
ugucuugggccacacaugaaauucacaaacac

SEQ ID NO: 529652 - RNA, 32 nt, Human
ugucuugggcgaggcagcugugagcauugcac

SEQ ID NO: 529653 - RNA, 32 nt, Human
ugucuuggggguggaaagggagggaugaauug

SEQ ID NO: 529654 - RNA, 32 nt, Human
ugucuuggucacugcugagacccacaggucua

SEQ ID NO: 529655 - RNA, 32 nt, Human
ugucuuggucucaaguugccucauugcggcug

SEQ ID NO: 529656 - RNA, 32 nt, Human
ugucuuggucuguugcccuccuucuuggcaug

SEQ ID NO: 529657 - RNA, 32 nt, Human
ugucuugguugucagugguggcaccaggaugg

SEQ ID NO: 529658 - RNA, 32 nt, Human
ugucuugugugagguguucugccgggauagaa

SEQ ID NO: 529659 - RNA, 32 nt, Human
ugucuugugugugguacuucauguuuucuugc

SEQ ID NO: 529660 - RNA, 32 nt, Human
ugucuuguuucagugagagacgcccuauuucu

SEQ ID NO: 529661 - RNA, 32 nt, Human
ugucuuuaaaaauuaaguggaagaagaauuac

SEQ ID NO: 529662 - RNA, 32 nt, Human
ugucuuuaaacagcaacuacagaaguggaagu

SEQ ID NO: 529663 - RNA, 32 nt, Human
ugucuuuaaauacuucaugagcauucauaauu

SEQ ID NO: 529664 - RNA, 32 nt, Human
ugucuuuaagaaauaaguggcuuuuguuguug

SEQ ID NO: 529665 - RNA, 32 nt, Human
ugucuuuaccaaaaguuuaaaaauuagcuugg

SEQ ID NO: 529666 - RNA, 22 nt, Human
ugucuuuacuaaaaauacaaaa

SEQ ID NO: 529667 - RNA, 32 nt, Human
ugucuuuacuaaaaauacaaaaauuacccaag

SEQ ID NO: 529668 - RNA, 32 nt, Human
ugucuuuacuaaaaauacaaaaauuagccagg

SEQ ID NO: 529669 - RNA, 32 nt, Human
ugucuuuacuaaaaauacaaaaauuagccggg

SEQ ID NO: 529670 - RNA, 32 nt, Human
ugucuuuacuaaaaauacaaaaauuagcuggg

SEQ ID NO: 529671 - RNA, 32 nt, Human
ugucuuuacuaaaaauauaaaaauuagcuggg

SEQ ID NO: 529672 - RNA, 32 nt, Human
ugucuuuaucagaggucccucugccaggggga

SEQ ID NO: 529673 - RNA, 32 nt, Human
ugucuuucaccaggcuggcaaaagcagugcaa

SEQ ID NO: 529674 - RNA, 32 nt, Human
ugucuuucaccuguaaucccagcacuuuggga

SEQ ID NO: 529675 - RNA, 25 nt, Human
ugucuuucagaaggugacuuucaug

SEQ ID NO: 529676 - RNA, 32 nt, Human
ugucuuucauucacuaaugagacugugucuga

SEQ ID NO: 529677 - RNA, 32 nt, Human
ugucuuuccguggagcugucgccaugaagguc

SEQ ID NO: 529678 - RNA, 32 nt, Human
ugucuuuccucucacccagucaaggagucccu

SEQ ID NO: 529679 - RNA, 32 nt, Human
ugucuuuccucucccugccucccaccagacuu

SEQ ID NO: 529680 - RNA, 32 nt, Human
ugucuuuccucuuccuccuagcuggcuuuaca

SEQ ID NO: 529681 - RNA, 32 nt, Human
ugucuuucucaccucuccuucacuuuuccuag

SEQ ID NO: 529682 - RNA, 32 nt, Human
ugucuuucuccucuccuaagucuuugcuuucc

SEQ ID NO: 529683 - RNA, 32 nt, Human
ugucuuucuccucuccuacauccauuucuucc

SEQ ID NO: 529684 - RNA, 32 nt, Human
ugucuuucuccucuggagaguagaugcuugcu

SEQ ID NO: 529685 - RNA, 32 nt, Human
ugucuuucuccucuuccuauucugucaucucc

SEQ ID NO: 529686 - RNA, 32 nt, Human
ugucuuucuguggacucaacauucacuucgau

SEQ ID NO: 529687 - RNA, 32 nt, Human
ugucuuucuguggagcugucgccaugaagguc

SEQ ID NO: 529688 - RNA, 32 nt, Human
ugucuuugaacucugcaccuccuuccaggcca

SEQ ID NO: 529689 - RNA, 21 nt, Human
ugucuuugaagcugccuccgc

SEQ ID NO: 529690 - RNA, 32 nt, Human
ugucuuugagguucugacugguguuuuacaac

SEQ ID NO: 529691 - RNA, 21 nt, Human
ugucuuugauuuuuuguucca

SEQ ID NO: 529692 - RNA, 32 nt, Human
ugucuuugcccucuguuccuuccagagacuau

SEQ ID NO: 529693 - RNA, 32 nt, Human
ugucuuugccucccacuguucucuccacucuc

SEQ ID NO: 529694 - RNA, 32 nt, Human
ugucuuugcuguauuuugaaaaacacguguug

SEQ ID NO: 529695 - RNA, 32 nt, Human
ugucuuugcuguguuuuucuccacuucuaaau

SEQ ID NO: 529696 - RNA, 32 nt, Human
ugucuuuggaaaauuacaacacugccuuugca

SEQ ID NO: 529697 - RNA, 32 nt, Human
ugucuuuggcucuuuguagugugcagaaagca

SEQ ID NO: 529698 - RNA, 32 nt, Human
ugucuuugggccugggucuguccuccaagaga

SEQ ID NO: 529699 - RNA, 22 nt, Human
ugucuuugggguuuucuuccca

SEQ ID NO: 529700 - RNA, 24 nt, Human
ugucuuugguccaacguuguucca

SEQ ID NO: 529701 - RNA, 32 nt, Human
ugucuuugguucagcaguuuuauugugaguug

SEQ ID NO: 529702 - RNA, 32 nt, Human
ugucuuuguaagucagcaugcucuugcuugaa

SEQ ID NO: 529703 - RNA, 31 nt, Human
ugucuuuguccccagcccuggagccauccug

SEQ ID NO: 529704 - RNA, 22 nt, Human
ugucuuugucuugcuguuuuca

SEQ ID NO: 529705 - RNA, 32 nt, Human
ugucuuuguugguggaaguaucuacugaagua

SEQ ID NO: 529706 - RNA, 32 nt, Human
ugucuuuguuugcaaaccuuucucagagcgac

SEQ ID NO: 529707 - RNA, 32 nt, Human
ugucuuuuagccuucaacuuuguauccaucag

SEQ ID NO: 529708 - RNA, 32 nt, Human
ugucuuuuccucaccaccuucccuccaaaaca

SEQ ID NO: 529709 - RNA, 22 nt, Human
ugucuuuucuaaaaauacaaaa

SEQ ID NO: 529710 - RNA, 32 nt, Human
ugucuuuucuguuuuaaucauagaugaaucuu

SEQ ID NO: 529711 - RNA, 32 nt, Human
ugucuuuugccaggcuagagacagggagagca

SEQ ID NO: 529712 - RNA, 32 nt, Human
ugucuuuugccucugcaauucuuuuuguagcu

SEQ ID NO: 529713 - RNA, 32 nt, Human
ugucuuuuguucucaugaauagucacuggggc

SEQ ID NO: 529714 - RNA, 32 nt, Human
ugucuuuuucauuuuuaauuuauugucauaca

SEQ ID NO: 529715 - RNA, 32 nt, Human
ugugaaaaaccaagaaaaagauaugguuguau

SEQ ID NO: 529716 - RNA, 32 nt, Human
ugugaaaaagccuuuaaaugauugucacacuu

SEQ ID NO: 529717 - RNA, 32 nt, Human
ugugaaaacuuuuaacaguuacugaacuaugu

SEQ ID NO: 529718 - RNA, 32 nt, Human
ugugaaaagcugugauuucauuucuuaucagu

SEQ ID NO: 529719 - RNA, 26 nt, Human
ugugaaaaggcaaauuuguauaugua

SEQ ID NO: 529720 - RNA, 32 nt, Human
ugugaaaaguauacacaaagggcucugaagcu

SEQ ID NO: 529721 - RNA, 32 nt, Human
ugugaaaaucagcugguucugcugcuugguuu

SEQ ID NO: 529722 - RNA, 32 nt, Human
ugugaaacaaccugggcaacauggugaaaccc

SEQ ID NO: 529723 - RNA, 32 nt, Human
ugugaaacacuuaacuggacaaacuguaguuu

SEQ ID NO: 529724 - RNA, 32 nt, Human
ugugaaaccaauauuggcaaauaguacuuuaa

SEQ ID NO: 529725 - RNA, 32 nt, Human
ugugaaaccucacccuucuggagcacggggcc

SEQ ID NO: 529726 - RNA, 32 nt, Human
ugugaaacuauggcuuaacacuguuaaagacu

SEQ ID NO: 529727 - RNA, 32 nt, Human
ugugaaacugauuucagauugcugaccuccag

SEQ ID NO: 529728 - RNA, 32 nt, Human
ugugaaacuguaaauuucauacauuugacuuc

SEQ ID NO: 529729 - RNA, 32 nt, Human
ugugaaagaaaacgucagucugccuguaaauu

SEQ ID NO: 529730 - RNA, 32 nt, Human
ugugaaagaggaaugugggagauugggacagc

SEQ ID NO: 529731 - RNA, 32 nt, Human
ugugaaagcccccuucugcugccugcggcugg

SEQ ID NO: 529732 - RNA, 32 nt, Human
ugugaaagcugaugcccaugugcccugagagc

SEQ ID NO: 529733 - RNA, 32 nt, Human
ugugaaaggaacuuucagauuaagaaauuucu

SEQ ID NO: 529734 - RNA, 22 nt, Human
ugugaaaguaauauuuuuuaua

SEQ ID NO: 529735 - RNA, 32 nt, Human
ugugaaaguacuuggagaaacugaggccucuu

SEQ ID NO: 529736 - RNA, 32 nt, Human
ugugaaagugguggagggcaauggaagggaac

SEQ ID NO: 529737 - RNA, 32 nt, Human
ugugaaaguuuggaggagggaggcaggaggug

SEQ ID NO: 529738 - RNA, 32 nt, Human
ugugaaauaauuugggcuuaaaagugaacaua

SEQ ID NO: 529739 - RNA, 32 nt, Human
ugugaaauagccaaucuccaccaguccuguau

SEQ ID NO: 529740 - RNA, 23 nt, Human
ugugaaaugaugagggcauuuua

SEQ ID NO: 529741 - RNA, 32 nt, Human
ugugaaauggcaguaaggaagaaaacagaaua

SEQ ID NO: 529742 - RNA, 32 nt, Human
ugugaaauguggagacuuccacauucucaguu

SEQ ID NO: 529743 - RNA, 23 nt, Human
ugugaaauuauggaggaguuuua

SEQ ID NO: 529744 - RNA, 21 nt, Human
ugugaaauucucagaguguuu

SEQ ID NO: 529745 - RNA, 19 nt, Human
ugugaaauugcaaguguuu

SEQ ID NO: 529746 - RNA, 32 nt, Human
ugugaaauuggcucucugggggccaaggccuu

SEQ ID NO: 529747 - RNA, 22 nt, Human
ugugaaauuguguagaguguuu

SEQ ID NO: 529748 - RNA, 32 nt, Human
ugugaaauuuacuagcaaaauuaagcuuucau

SEQ ID NO: 529749 - RNA, 32 nt, Human
ugugaacacacacguguauacaugcaugcaca

SEQ ID NO: 529750 - RNA, 32 nt, Human
ugugaacagaagaacaacaacuccaccggaua

SEQ ID NO: 529751 - RNA, 32 nt, Human
ugugaacagagcagagugggaggcaggcauca

SEQ ID NO: 529752 - RNA, 32 nt, Human
ugugaacagcuccaccaccaagcgccugcaga

SEQ ID NO: 529753 - RNA, 32 nt, Human
ugugaacagcuguguucucauuuccuuuucuu

SEQ ID NO: 529754 - RNA, 32 nt, Human
ugugaacaguagugacuuuucccgcuguuucu

SEQ ID NO: 529755 - RNA, 32 nt, Human
ugugaaccauaggcacaacccaggaaguuucc

SEQ ID NO: 529756 - RNA, 32 nt, Human
ugugaaccauguccugagggccuugcagggaa

SEQ ID NO: 529757 - RNA, 32 nt, Human
ugugaacccaggaggcacagcuugcagugagc

SEQ ID NO: 529758 - RNA, 32 nt, Human
ugugaacccaggaggcagagcuugcagugagc

SEQ ID NO: 529759 - RNA, 32 nt, Human
ugugaacccaggaggcggagcuugcagugagc

SEQ ID NO: 529760 - RNA, 32 nt, Human
ugugaacccaggaggcggugcuugcagggagc

SEQ ID NO: 529761 - RNA, 32 nt, Human
ugugaaccccugcacccaaccccacaucuggg

SEQ ID NO: 529762 - RNA, 32 nt, Human
ugugaacccgggacgcagggguugcagugagc

SEQ ID NO: 529763 - RNA, 32 nt, Human
ugugaacccgggagauggcgcuugcagugagc

SEQ ID NO: 529764 - RNA, 32 nt, Human
ugugaacccgggagcggagguugcagugagcu

SEQ ID NO: 529765 - RNA, 32 nt, Human
ugugaacccgggaggcagagcuugcagugagc

SEQ ID NO: 529766 - RNA, 32 nt, Human
ugugaacccgggaggcagagcuuguggugagc

SEQ ID NO: 529767 - RNA, 32 nt, Human
ugugaacccgggaggcauagcuugcagugagc

SEQ ID NO: 529768 - RNA, 32 nt, Human
ugugaacccgggaggcggagcuugcagugagc

SEQ ID NO: 529769 - RNA, 32 nt, Human
ugugaacccgggagguggagcuuccagugagc

SEQ ID NO: 529770 - RNA, 32 nt, Human
ugugaacccgggagguggagcuugcagugagc

SEQ ID NO: 529771 - RNA, 32 nt, Human
ugugaacccguccucaccauguuugccacauc

SEQ ID NO: 529772 - RNA, 32 nt, Human
ugugaaccgccugcacugaauucacgugagga

SEQ ID NO: 529773 - RNA, 32 nt, Human
ugugaaccuagacuuagaacaaauccugcuuu

SEQ ID NO: 529774 - RNA, 32 nt, Human
ugugaaccugggaggcagagcuugcagugagc

SEQ ID NO: 529775 - RNA, 32 nt, Human
ugugaaccugggaggcggagcuugcaaugaac

SEQ ID NO: 529776 - RNA, 32 nt, Human
ugugaaccugggaggcggagcuugcagugagc

SEQ ID NO: 529777 - RNA, 32 nt, Human
ugugaaccugggagguggagcuugcagugaac

SEQ ID NO: 529778 - RNA, 32 nt, Human
ugugaaccugggagguggagcuugcagugagc

SEQ ID NO: 529779 - RNA, 32 nt, Human
ugugaaccugugagguggagcuugcagugagc

SEQ ID NO: 529780 - RNA, 32 nt, Human
ugugaaccuguguacgcacacacacauauaca

SEQ ID NO: 529781 - RNA, 32 nt, Human
ugugaacgccaaacuaaaguuuacagucuuuc

SEQ ID NO: 529782 - RNA, 32 nt, Human
ugugaacguguauguaccuaggauauguuaaa

SEQ ID NO: 529783 - RNA, 32 nt, Human
ugugaacguguguauguaaauguaugugugua

SEQ ID NO: 529784 - RNA, 32 nt, Human
ugugaacucaaggccuucccuaccucacccug

SEQ ID NO: 529785 - RNA, 32 nt, Human
ugugaacuccacuccacggcugcccagggcag

SEQ ID NO: 529786 - RNA, 32 nt, Human
ugugaacuccuugcaaagaugauaugaggcua

SEQ ID NO: 529787 - RNA, 32 nt, Human
ugugaacugcucaacacacagaucuccuacuc

SEQ ID NO: 529788 - RNA, 32 nt, Human
ugugaacuuaaagagaaggaauauuuguguag

SEQ ID NO: 529789 - RNA, 32 nt, Human
ugugaacuucacuaacagggaguggcaguguc

SEQ ID NO: 529790 - RNA, 32 nt, Human
ugugaacuuccccugcacugccagggccguuc

SEQ ID NO: 529791 - RNA, 32 nt, Human
ugugaacuucuguggcuucaguucucaugcug

SEQ ID NO: 529792 - RNA, 32 nt, Human
ugugaacuugcucaccuggaccacuguauccu

SEQ ID NO: 529793 - RNA, 32 nt, Human
ugugaagaaagaaaaguggagugcuguaucuu

SEQ ID NO: 529794 - RNA, 21 nt, Human
ugugaagaacuaaggugggga

SEQ ID NO: 529795 - RNA, 32 nt, Human
ugugaagaacugcuacauauucuacagugcuu

SEQ ID NO: 529796 - RNA, 32 nt, Human
ugugaagaaggaccagcugcuguuuagaaaau

SEQ ID NO: 529797 - RNA, 32 nt, Human
ugugaagaaggugccuuucuuccccuucgccu

SEQ ID NO: 529798 - RNA, 23 nt, Human
ugugaagaaucuguugcuaugua

SEQ ID NO: 529799 - RNA, 32 nt, Human
ugugaagaauugaggcaugcaacccaauagca

SEQ ID NO: 529800 - RNA, 32 nt, Human
ugugaagacaggcuucuuggaguaggggcagc

SEQ ID NO: 529801 - RNA, 32 nt, Human
ugugaagacagggagagccaggccccagcaga

SEQ ID NO: 529802 - RNA, 32 nt, Human
ugugaagacuguuuccagccuggcugugagcc

SEQ ID NO: 529803 - RNA, 32 nt, Human
ugugaagagacgccccacccacccucagccag

SEQ ID NO: 529804 - RNA, 32 nt, Human
ugugaagagcaccugucacaacaggaaaugca

SEQ ID NO: 529805 - RNA, 32 nt, Human
ugugaagagcugggugaagggguuggagcaug

SEQ ID NO: 529806 - RNA, 32 nt, Human
ugugaagaggcaggcacagaaaaucuauccau

SEQ ID NO: 529807 - RNA, 32 nt, Human
ugugaagaggccugagagcgggagggccaggc

SEQ ID NO: 529808 - RNA, 20 nt, Human
ugugaagaggugccuuccac

SEQ ID NO: 529809 - RNA, 32 nt, Human
ugugaagaucgccagagaguucuguguuucau

SEQ ID NO: 529810 - RNA, 32 nt, Human
ugugaagaugcagaauugccuccuggacugaa

SEQ ID NO: 529811 - RNA, 32 nt, Human
ugugaagaugucuuccucucggacccucugcu

SEQ ID NO: 529812 - RNA, 32 nt, Human
ugugaagaugugggugacacagggggacagga

SEQ ID NO: 529813 - RNA, 32 nt, Human
ugugaagcaaaaagaugccuuuuaccaugaau

SEQ ID NO: 529814 - RNA, 32 nt, Human
ugugaagcacacagcucugcagccugggcucu

SEQ ID NO: 529815 - RNA, 32 nt, Human
ugugaagcagaagagaaaagcuggaggaaggc

SEQ ID NO: 529816 - RNA, 32 nt, Human
ugugaagccagaggaccuggagcugcugaugc

SEQ ID NO: 529817 - RNA, 32 nt, Human
ugugaagcccaggaggugguguuggcugcagg

SEQ ID NO: 529818 - RNA, 32 nt, Human
ugugaagcccagggcaagaggaugcggguguc

SEQ ID NO: 529819 - RNA, 32 nt, Human
ugugaagcccuggaagggcucuugccuagaau

SEQ ID NO: 529820 - RNA, 32 nt, Human
ugugaagccugucacccagaacuggaugguac

SEQ ID NO: 529821 - RNA, 32 nt, Human
ugugaagcuagcacugucuguaauacuucuaa

SEQ ID NO: 529822 - RNA, 32 nt, Human
ugugaagcugagcucagggccggaccugggga

SEQ ID NO: 529823 - RNA, 32 nt, Human
ugugaagcuuuuccuuuagccugggacagaag

SEQ ID NO: 529824 - RNA, 32 nt, Human
ugugaaggaaggcaggagccugcaggggagca

SEQ ID NO: 529825 - RNA, 32 nt, Human
ugugaaggaauugagccagaucucucucccua

SEQ ID NO: 529826 - RNA, 32 nt, Human
ugugaaggacccugaaccagaggacucagcga

SEQ ID NO: 529827 - RNA, 32 nt, Human
ugugaaggacucacuuuuacugggauaaacaa

SEQ ID NO: 529828 - RNA, 32 nt, Human
ugugaaggagcuugugaaggcagaggaagauu

SEQ ID NO: 529829 - RNA, 32 nt, Human
ugugaaggaggcagggguugggacaagugcua

SEQ ID NO: 529830 - RNA, 21 nt, Human
ugugaaggcagaguaugggga

SEQ ID NO: 529831 - RNA, 32 nt, Human
ugugaaggccccgagcccuggaagcccagacu

SEQ ID NO: 529832 - RNA, 32 nt, Human
ugugaaggccugaaacaggcaaauuugugauc

SEQ ID NO: 529833 - RNA, 32 nt, Human
ugugaagggagaaagggagagaaaacucuucu

SEQ ID NO: 529834 - RNA, 32 nt, Human
ugugaagggauuagaugggauggucucugagg

SEQ ID NO: 529835 - RNA, 32 nt, Human
ugugaagggcugggaccacuugcccagacugg

SEQ ID NO: 529836 - RNA, 21 nt, Human
ugugaagggggagaugggaga

SEQ ID NO: 529837 - RNA, 21 nt, Human
ugugaagguccagucauucca

SEQ ID NO: 529838 - RNA, 32 nt, Human
ugugaagguggaaucagagaggggccccgcgg

SEQ ID NO: 529839 - RNA, 32 nt, Human
ugugaaggugugugucauacacagggccuagu

SEQ ID NO: 529840 - RNA, 32 nt, Human
ugugaaguaaccaggaggaauggggaaagaag

SEQ ID NO: 529841 - RNA, 32 nt, Human
ugugaagucuugacacugccuccugggagcau

SEQ ID NO: 529842 - RNA, 32 nt, Human
ugugaagugagaagaaacuuuaugcuuguuua

SEQ ID NO: 529843 - RNA, 32 nt, Human
ugugaagugauggagaccauggacagugauau

SEQ ID NO: 529844 - RNA, 32 nt, Human
ugugaaguggagaggccgaggagcagccggcc

SEQ ID NO: 529845 - RNA, 32 nt, Human
ugugaagugguucacccuugaggaccaggagc

SEQ ID NO: 529846 - RNA, 21 nt, Human
ugugaauaaacuguucuucau

SEQ ID NO: 529847 - RNA, 32 nt, Human
ugugaauaaaguguucuacagucagccagcac

SEQ ID NO: 529848 - RNA, 32 nt, Human
ugugaauagccacugcacuccagccugggcaa

SEQ ID NO: 529849 - RNA, 32 nt, Human
ugugaauagccacugcacuccaucuugggcaa

SEQ ID NO: 529850 - RNA, 32 nt, Human
ugugaauagccacugcacucuagucuggggaa

SEQ ID NO: 529851 - RNA, 32 nt, Human
ugugaauagccacugcacuucagccugggcaa

SEQ ID NO: 529852 - RNA, 32 nt, Human
ugugaauaugaucuuucucucagaauaccuua

SEQ ID NO: 529853 - RNA, 32 nt, Human
ugugaauaugugaaacaguaaauaugaaagaa

SEQ ID NO: 529854 - RNA, 32 nt, Human
ugugaauauuagcuuuugugaucagaauuaug

SEQ ID NO: 529855 - RNA, 32 nt, Human
ugugaauauucaaugggaccaauaugaacaca

SEQ ID NO: 529856 - RNA, 32 nt, Human
ugugaaucacugcaggcuguguucuugcaucu

SEQ ID NO: 529857 - RNA, 32 nt, Human
ugugaaucagcaggugccccgaggccaggccu

SEQ ID NO: 529858 - RNA, 32 nt, Human
ugugaaucagccuccccacucuccuuggucau

SEQ ID NO: 529859 - RNA, 32 nt, Human
ugugaaucaguacaguuuucuuacccuuucuu

SEQ ID NO: 529860 - RNA, 32 nt, Human
ugugaaucuccaagugccuguguaauaaauaa

SEQ ID NO: 529861 - RNA, 32 nt, Human
ugugaaucucuccaaagccaacucaguucauc

SEQ ID NO: 529862 - RNA, 31 nt, Human
ugugaaucucuucucccuuugaagaaacuau

SEQ ID NO: 529863 - RNA, 32 nt, Human
ugugaaucugcaauggcugaaaagaguuguga

SEQ ID NO: 529864 - RNA, 32 nt, Human
ugugaaucugcuuuuccucugccuucggaggg

SEQ ID NO: 529865 - RNA, 32 nt, Human
ugugaaucuucaugaggccaucuugcuuuguc

SEQ ID NO: 529866 - RNA, 32 nt, Human
ugugaaugaaauggaugucacagagugucaug

SEQ ID NO: 529867 - RNA, 32 nt, Human
ugugaaugacaaagugcuacugccucaauaac

SEQ ID NO: 529868 - RNA, 32 nt, Human
ugugaaugacaucugaagguguuaucuuacac

SEQ ID NO: 529869 - RNA, 32 nt, Human
ugugaaugacccccuuccccaggcauccccac

SEQ ID NO: 529870 - RNA, 32 nt, Human
ugugaaugagugugugcacaugagugcacggg

SEQ ID NO: 529871 - RNA, 23 nt, Human
ugugaaugaugagcugccuccau

SEQ ID NO: 529872 - RNA, 30 nt, Human
ugugaaugaugggcucuuggaagcacuguc

SEQ ID NO: 529873 - RNA, 32 nt, Human
ugugaaugcaccacggcacucaagccugggca

SEQ ID NO: 529874 - RNA, 32 nt, Human
ugugaaugccgcguccuguccuggugacagga

SEQ ID NO: 529875 - RNA, 32 nt, Human
ugugaauggccuuccacuucagucuuaggcag

SEQ ID NO: 529876 - RNA, 32 nt, Human
ugugaaugguagacauuuaucacaugugauau

SEQ ID NO: 529877 - RNA, 32 nt, Human
ugugaauguguauguauacuuacauaugugug

SEQ ID NO: 529878 - RNA, 32 nt, Human
ugugaauuacuuuugagauaaccgcauuaaca

SEQ ID NO: 529879 - RNA, 32 nt, Human
ugugaauuaggaccagcgcaaugaaugcucaa

SEQ ID NO: 529880 - RNA, 32 nt, Human
ugugaauuaguugcugcacuccagccuaggca

SEQ ID NO: 529881 - RNA, 32 nt, Human
ugugaauucugucauugccaaccuucuugaag

SEQ ID NO: 529882 - RNA, 32 nt, Human
ugugaauugccacugcacuccagccuaagcaa

SEQ ID NO: 529883 - RNA, 32 nt, Human
ugugaauugguccucagauagucaggccuggg

SEQ ID NO: 529884 - RNA, 32 nt, Human
ugugaauuguguaacaaaaacauguucuuaua

SEQ ID NO: 529885 - RNA, 32 nt, Human
ugugaauuucugugacuuccacaugccaaaau

SEQ ID NO: 529886 - RNA, 21 nt, Human
ugugacaaaaccuuuaagcca

SEQ ID NO: 529887 - RNA, 32 nt, Human
ugugacaaagcuuucagacacaauucagcccu

SEQ ID NO: 529888 - RNA, 32 nt, Human
ugugacaacucuagaccugccugcuuuaucua

SEQ ID NO: 529889 - RNA, 32 nt, Human
ugugacaaggucuuacccagcccagggauucu

SEQ ID NO: 529890 - RNA, 32 nt, Human
ugugacaagguggucuugucacacaaccaagg

SEQ ID NO: 529891 - RNA, 21 nt, Human
ugugacaauauaugcuguaga

SEQ ID NO: 529892 - RNA, 22 nt, Human
ugugacaauauauuuuauguau

SEQ ID NO: 529893 - RNA, 32 nt, Human
ugugacaauauugaaacaccacugugcagauu

SEQ ID NO: 529894 - RNA, 20 nt, Human
ugugacaaucugccuuucac

SEQ ID NO: 529895 - RNA, 32 nt, Human
ugugacaaugcccacuccucauucauaaggug

SEQ ID NO: 529896 - RNA, 32 nt, Human
ugugacacccccucgacucccuggugacgcuc

SEQ ID NO: 529897 - RNA, 32 nt, Human
ugugacaccuucagcaggucucagggaagaug

SEQ ID NO: 529898 - RNA, 32 nt, Human
ugugacacucgagucugagccagccccucagg

SEQ ID NO: 529899 - RNA, 32 nt, Human
ugugacacugcacuccagccugggcaacagag

SEQ ID NO: 529900 - RNA, 32 nt, Human
ugugacacugcccuccagccugggugacagag

SEQ ID NO: 529901 - RNA, 32 nt, Human
ugugacacugugggugaaauguucuacacacc

SEQ ID NO: 529902 - RNA, 32 nt, Human
ugugacagacacauuuucuuagccuucaccuu

SEQ ID NO: 529903 - RNA, 32 nt, Human
ugugacagagaagggauagggaaauccucucu

SEQ ID NO: 529904 - RNA, 32 nt, Human
ugugacagagcagagccagggccaggcgcacc

SEQ ID NO: 529905 - RNA, 32 nt, Human
ugugacagaguuucuuucugacaccugagucu

SEQ ID NO: 529906 - RNA, 32 nt, Human
ugugacagccauugugagacugaugcacaaac

SEQ ID NO: 529907 - RNA, 32 nt, Human
ugugacagcggggauggaugugaccuugcccg

SEQ ID NO: 529908 - RNA, 32 nt, Human
ugugacaggaggcagcagaaguugcagagaag

SEQ ID NO: 529909 - RNA, 32 nt, Human
ugugacaggcccugccugccacccuaggcagg

SEQ ID NO: 529910 - RNA, 32 nt, Human
ugugacaggggcaggaggagugugcuagaacc

SEQ ID NO: 529911 - RNA, 32 nt, Human
ugugacagguaacaaauuuggggaagacagca

SEQ ID NO: 529912 - RNA, 32 nt, Human
ugugacagucacugcauuugccugcuucuuuc

SEQ ID NO: 529913 - RNA, 32 nt, Human
ugugacagucucuauucugucguuuugcuccu

SEQ ID NO: 529914 - RNA, 32 nt, Human
ugugacagugccuugucguccucuuugaaaca

SEQ ID NO: 529915 - RNA, 32 nt, Human
ugugacauagauuauacuacuacuaauuuuug

SEQ ID NO: 529916 - RNA, 32 nt, Human
ugugacauccccaccagccucagaugagacgg

SEQ ID NO: 529917 - RNA, 32 nt, Human
ugugacaucugcaagccaaggagagaggcugc

SEQ ID NO: 529918 - RNA, 32 nt, Human
ugugacaucuggauauaaaaugaaaauaaaug

SEQ ID NO: 529919 - RNA, 32 nt, Human
ugugacaugaagcaacagaaacugagaucaaa

SEQ ID NO: 529920 - RNA, 32 nt, Human
ugugacaugcuggccucagagauucaugucac

SEQ ID NO: 529921 - RNA, 32 nt, Human
ugugacauuucuagcauauccaaggcaccacc

SEQ ID NO: 529922 - RNA, 32 nt, Human
ugugaccaagaguucaggggcccagguaccuu

SEQ ID NO: 529923 - RNA, 32 nt, Human
ugugaccaagugacaaacuccuucugaaccug

SEQ ID NO: 529924 - RNA, 32 nt, Human
ugugaccacacaccugguuuuaacucaagacc

SEQ ID NO: 529925 - RNA, 32 nt, Human
ugugaccacagcugcucuccaggugcugggcc

SEQ ID NO: 529926 - RNA, 32 nt, Human
ugugaccacaggcugguguguaggugguaaaa

SEQ ID NO: 529927 - RNA, 32 nt, Human
ugugaccaccacacuccaggaggcagccccau

SEQ ID NO: 529928 - RNA, 32 nt, Human
ugugaccacuuucccccacccuucccacccuc

SEQ ID NO: 529929 - RNA, 32 nt, Human
ugugaccagaaagcuucauccacagccuugca

SEQ ID NO: 529930 - RNA, 21 nt, Human
ugugaccagacugaauuuccu

SEQ ID NO: 529931 - RNA, 32 nt, Human
ugugaccagcucccaguaaaaaccccaggcac

SEQ ID NO: 529932 - RNA, 32 nt, Human
ugugaccaguguccaagggcaucccauucuca

SEQ ID NO: 529933 - RNA, 32 nt, Human
ugugaccauaacuguuuaggcuucuguguguu

SEQ ID NO: 529934 - RNA, 32 nt, Human
ugugaccaucuuuccugagcaccaagggcuuc

SEQ ID NO: 529935 - RNA, 32 nt, Human
ugugaccaugaucuguugauaucuuugaaucu

SEQ ID NO: 529936 - RNA, 32 nt, Human
ugugacccaagccgagcguggaagaauggggu

SEQ ID NO: 529937 - RNA, 32 nt, Human
ugugacccaaguggcccggaccaguuuggggc

SEQ ID NO: 529938 - RNA, 32 nt, Human
ugugaccccaaaccaucucuccaaagcauuaa

SEQ ID NO: 529939 - RNA, 32 nt, Human
ugugaccccauucuguaaucaacugagcuagu

SEQ ID NO: 529940 - RNA, 32 nt, Human
ugugacccccuucaagucuuccuucaccacuc

SEQ ID NO: 529941 - RNA, 32 nt, Human
ugugaccccucgggacugccuggugcaggugg

SEQ ID NO: 529942 - RNA, 32 nt, Human
ugugacccguggucaacuuuaacaucagcaaa

SEQ ID NO: 529943 - RNA, 32 nt, Human
ugugacccuucuucccccuccucucuccucuc

SEQ ID NO: 529944 - RNA, 32 nt, Human
ugugaccgagggagggagggcugccugauccc

SEQ ID NO: 529945 - RNA, 18 nt, Human
ugugaccgccugaugucc

SEQ ID NO: 529946 - RNA, 32 nt, Human
ugugaccuagggugaugaguucaccucucugg

SEQ ID NO: 529947 - RNA, 32 nt, Human
ugugaccucaucuuucucauggugcuauccug

SEQ ID NO: 529948 - RNA, 32 nt, Human
ugugaccuccggagcccugccugccccugcuc

SEQ ID NO: 529949 - RNA, 32 nt, Human
ugugaccugacaccugccgcugcuugagugga

SEQ ID NO: 529950 - RNA, 31 nt, Human
ugugaccugcaacgggguggcauucacuuag

SEQ ID NO: 529951 - RNA, 32 nt, Human
ugugaccugcagcugacucaaagccuugcgug

SEQ ID NO: 529952 - RNA, 32 nt, Human
ugugaccugcaggagcuggaggcgggcgggaa

SEQ ID NO: 529953 - RNA, 32 nt, Human
ugugaccugcucucuucccuccaggcugacuu

SEQ ID NO: 529954 - RNA, 32 nt, Human
ugugaccugcugucugcacccuguugucugca

SEQ ID NO: 529955 - RNA, 32 nt, Human
ugugaccuuaggcuggagugcaauggcaugau

SEQ ID NO: 529956 - RNA, 32 nt, Human
ugugaccuuuguccucacauauguuaucacuc

SEQ ID NO: 529957 - RNA, 32 nt, Human
ugugacgaaaugccagcugaggcacaugccuu

SEQ ID NO: 529958 - RNA, 32 nt, Human
ugugacgaggccuggccaggggugcaggagca

SEQ ID NO: 529959 - RNA, 32 nt, Human
ugugacgaugccacugcagcccgcaccuuguc

SEQ ID NO: 529960 - RNA, 32 nt, Human
ugugacgccacagccuggugaggagggggcug

SEQ ID NO: 529961 - RNA, 32 nt, Human
ugugacggcagugccuacacgccaagguaaga

SEQ ID NO: 529962 - RNA, 32 nt, Human
ugugacggccuccagcccacaggccugcuuuc

SEQ ID NO: 529963 - RNA, 32 nt, Human
ugugacggggcuggggcugagcuuucuggggg

SEQ ID NO: 529964 - RNA, 32 nt, Human
ugugacgucugagaccuuuucccagcuggagc

SEQ ID NO: 529965 - RNA, 32 nt, Human
ugugacguggaagacgccgaagaggugaggga

SEQ ID NO: 529966 - RNA, 32 nt, Human
ugugacuacccacuccaaagguugacuguaag

SEQ ID NO: 529967 - RNA, 32 nt, Human
ugugacuagcuacugcacuccaaccugggcaa

SEQ ID NO: 529968 - RNA, 19 nt, Human
ugugacucaaggccugcug

SEQ ID NO: 529969 - RNA, 32 nt, Human
ugugacucagaaaauccacaacuuuuuaccau

SEQ ID NO: 529970 - RNA, 24 nt, Human
ugugacuccacacccagcaugucu

SEQ ID NO: 529971 - RNA, 32 nt, Human
ugugacucccacugcacuccagcucggggaac

SEQ ID NO: 529972 - RNA, 32 nt, Human
ugugacuccccaggaccagggagauguuuaug

SEQ ID NO: 529973 - RNA, 32 nt, Human
ugugacucgggagacggaguggaacacccggc

SEQ ID NO: 529974 - RNA, 32 nt, Human
ugugacucuaagaacaaauggaugaaugaaua

SEQ ID NO: 529975 - RNA, 32 nt, Human
ugugacucucucucuaaugcugcucucgggaa

SEQ ID NO: 529976 - RNA, 32 nt, Human
ugugacucugacuggcuauagucucuggcacc

SEQ ID NO: 529977 - RNA, 32 nt, Human
ugugacugaaagaugaaguucaagagaaggga

SEQ ID NO: 529978 - RNA, 32 nt, Human
ugugacugauucucuuuugcauugguuuuuag

SEQ ID NO: 529979 - RNA, 32 nt, Human
ugugacugcaccacugcacagucugggcgaca

SEQ ID NO: 529980 - RNA, 22 nt, Human
ugugacugccagcugcuuccgc

SEQ ID NO: 529981 - RNA, 25 nt, Human
ugugacugccaggauaaagcuuccg

SEQ ID NO: 529982 - RNA, 32 nt, Human
ugugacugcccaggacucucagguugggcugg

SEQ ID NO: 529983 - RNA, 32 nt, Human
ugugacugccgcucugugccuaugucuugcuu

SEQ ID NO: 529984 - RNA, 32 nt, Human
ugugacugcgccacugcacuccagucugggac

SEQ ID NO: 529985 - RNA, 32 nt, Human
ugugacugcucacuuaugacgucucccccagu

SEQ ID NO: 529986 - RNA, 21 nt, Human
ugugacuggcccgggcuuccg

SEQ ID NO: 529987 - RNA, 19 nt, Human
ugugacuggcuucuuccac

SEQ ID NO: 529988 - RNA, 32 nt, Human
ugugacugggaaggcaauuucauacuaaacug

SEQ ID NO: 529989 - RNA, 32 nt, Human
ugugacugggcugugugaggguggggugggag

SEQ ID NO: 529990 - RNA, 32 nt, Human
ugugacuguaguccaccccugccugccuuguu

SEQ ID NO: 529991 - RNA, 32 nt, Human
ugugacuguaucauuaacugcuuuuguuuugc

SEQ ID NO: 529992 - RNA, 22 nt, Human
ugugacugugacagagcugucc

SEQ ID NO: 529993 - RNA, 32 nt, Human
ugugacuguggacgugcagucuccagcuugua

SEQ ID NO: 529994 - RNA, 23 nt, Human
ugugacuuaauuacacaugaaua

SEQ ID NO: 529995 - RNA, 32 nt, Human
ugugacuucaugauaggaaagaggaggaugag

SEQ ID NO: 529996 - RNA, 32 nt, Human
ugugacuugucccaggaccagaauguaccuaa

SEQ ID NO: 529997 - RNA, 32 nt, Human
ugugacuuucagugggagauggaaguuuuuca

SEQ ID NO: 529998 - RNA, 32 nt, Human
ugugacuuugcuucuuuuccugcucagcuucu

SEQ ID NO: 529999 - RNA, 18 nt, Human
ugugagaaaauaccuccc

SEQ ID NO: 530000 - RNA, 31 nt, Human
ugugagaaagcgagagaaagaggaacugaag

SEQ ID NO: 530001 - RNA, 32 nt, Human
ugugagaaaggugccuuucuucccccuucacg

SEQ ID NO: 530002 - RNA, 32 nt, Human
ugugagaaauccagcaucucaggcuccacugc

SEQ ID NO: 530003 - RNA, 32 nt, Human
ugugagaaaucuugcuaaucuauaugccacag

SEQ ID NO: 530004 - RNA, 21 nt, Human
ugugagaacaaauaccuuccu

SEQ ID NO: 530005 - RNA, 32 nt, Human
ugugagaacauggcugguagaggcucuagcug

SEQ ID NO: 530006 - RNA, 32 nt, Human
ugugagaacauguguaaugugugugcagacau

SEQ ID NO: 530007 - RNA, 32 nt, Human
ugugagaacgugacuaacugcugguaaguuuc

SEQ ID NO: 530008 - RNA, 32 nt, Human
ugugagaagcaacaccuugcucuggucaggaa

SEQ ID NO: 530009 - RNA, 21 nt, Human
ugugagaagcagagauaggga

SEQ ID NO: 530010 - RNA, 32 nt, Human
ugugagaagcagagauagggagaggaggugag

SEQ ID NO: 530011 - RNA, 21 nt, Human
ugugagaagcagcagagggga

SEQ ID NO: 530012 - RNA, 32 nt, Human
ugugagaaggcucauuucucauguuauccgga

SEQ ID NO: 530013 - RNA, 32 nt, Human
ugugagaaguucuccccugggguggggacucg

SEQ ID NO: 530014 - RNA, 32 nt, Human
ugugagaaugauuguucuuucacuugggcugu

SEQ ID NO: 530015 - RNA, 32 nt, Human
ugugagaaugcaaacccgaagccagacgcaca

SEQ ID NO: 530016 - RNA, 32 nt, Human
ugugagacaaagggcccugucacuggaagcca

SEQ ID NO: 530017 - RNA, 32 nt, Human
ugugagacaacugcacuccagugugggcgugc

SEQ ID NO: 530018 - RNA, 32 nt, Human
ugugagacagcccacauuggaaaauccagaaa

SEQ ID NO: 530019 - RNA, 32 nt, Human
ugugagaccaaaggaggagagauguguuuugu

SEQ ID NO: 530020 - RNA, 32 nt, Human
ugugagaccagcccagccaacauggucccagg

SEQ ID NO: 530021 - RNA, 32 nt, Human
ugugagaccaucauggugccagucuaggaccc

SEQ ID NO: 530022 - RNA, 19 nt, Human
ugugagaccugcucuucac

SEQ ID NO: 530023 - RNA, 32 nt, Human
ugugagacucucccaaggugcuguauuuuucu

SEQ ID NO: 530024 - RNA, 32 nt, Human
ugugagacuggcgcugccaccauguuccccag

SEQ ID NO: 530025 - RNA, 32 nt, Human
ugugagagacacacacaaacacauuucaaaca

SEQ ID NO: 530026 - RNA, 32 nt, Human
ugugagagaggguauugagucuggccugacaa

SEQ ID NO: 530027 - RNA, 32 nt, Human
ugugagagaggugguaauuacaggaaccagcc

SEQ ID NO: 530028 - RNA, 32 nt, Human
ugugagagcagugcuucugauccugcugucac

SEQ ID NO: 530029 - RNA, 32 nt, Human
ugugagagccugggugucugagaccgggaggg

SEQ ID NO: 530030 - RNA, 22 nt, Human
ugugagagggacugcguuugca

SEQ ID NO: 530031 - RNA, 32 nt, Human
ugugagauaaaauugcuugucuuucacuggaa

SEQ ID NO: 530032 - RNA, 32 nt, Human
ugugagauaagaaagaguuccuggaaccagga

SEQ ID NO: 530033 - RNA, 32 nt, Human
ugugagauccaccccugcccgcaaaacauugc

SEQ ID NO: 530034 - RNA, 32 nt, Human
ugugagaucuccaggacagagggagaaagauc

SEQ ID NO: 530035 - RNA, 32 nt, Human
ugugagaugaaugcaaacaucacaaagaaguu

SEQ ID NO: 530036 - RNA, 32 nt, Human
ugugagaugaaugcacacaucacaaagaaguu

SEQ ID NO: 530037 - RNA, 32 nt, Human
ugugagauggaaaaguuguuucauggcaucca

SEQ ID NO: 530038 - RNA, 32 nt, Human
ugugagauuaaccuugggacacaguggguuag

SEQ ID NO: 530039 - RNA, 32 nt, Human
ugugagauuccuggcugccucuuccaggcagu

SEQ ID NO: 530040 - RNA, 32 nt, Human
ugugagcacacagagaaaagaccaugugaaga

SEQ ID NO: 530041 - RNA, 32 nt, Human
ugugagcacacgcuggagugcagcguuccaaa

SEQ ID NO: 530042 - RNA, 32 nt, Human
ugugagcacacgugcccaugggcguacacgua

SEQ ID NO: 530043 - RNA, 32 nt, Human
ugugagcaccacugcacuaagccagugcggag

SEQ ID NO: 530044 - RNA, 32 nt, Human
ugugagcacccagcuacuggggacgggggcuc

SEQ ID NO: 530045 - RNA, 32 nt, Human
ugugagcaccugagcaugaaacucgacgcguu

SEQ ID NO: 530046 - RNA, 32 nt, Human
ugugagcacuagcucuggaggcaggugaguca

SEQ ID NO: 530047 - RNA, 32 nt, Human
ugugagcacuccccucuccguugugcccugga

SEQ ID NO: 530048 - RNA, 32 nt, Human
ugugagcagaaggcuucccaacucacccgucu

SEQ ID NO: 530049 - RNA, 32 nt, Human
ugugagcagguccacuucuccacccacugaga

SEQ ID NO: 530050 - RNA, 32 nt, Human
ugugagcauuagaccagccacagugccugauu

SEQ ID NO: 530051 - RNA, 32 nt, Human
ugugagccacagcaccuggccaaccaacacuu

SEQ ID NO: 530052 - RNA, 32 nt, Human
ugugagccacaugacuaugaauacugcugucc

SEQ ID NO: 530053 - RNA, 32 nt, Human
ugugagccaccacacccagccucuguaguucu

SEQ ID NO: 530054 - RNA, 32 nt, Human
ugugagccaccacacccagccugggucucucu

SEQ ID NO: 530055 - RNA, 32 nt, Human
ugugagccaccacgcccagccuguggccagca

SEQ ID NO: 530056 - RNA, 32 nt, Human
ugugagccaccgcacccagccugaguuucucu

SEQ ID NO: 530057 - RNA, 18 nt, Human
ugugagccaccgcugcca

SEQ ID NO: 530058 - RNA, 32 nt, Human
ugugagccacggcacccagccuagcucucaga

SEQ ID NO: 530059 - RNA, 32 nt, Human
ugugagccacugcacccagccugugauguuuc

SEQ ID NO: 530060 - RNA, 32 nt, Human
ugugagccacugcacccagcugagagugcuuc

SEQ ID NO: 530061 - RNA, 32 nt, Human
ugugagccacugcacccggccacaagauguaa

SEQ ID NO: 530062 - RNA, 32 nt, Human
ugugagccacugcacccggccgggaauuuauc

SEQ ID NO: 530063 - RNA, 32 nt, Human
ugugagccacugcaccucgccagauguccaau

SEQ ID NO: 530064 - RNA, 32 nt, Human
ugugagccacugcaccuggcaagaaacuuuuc

SEQ ID NO: 530065 - RNA, 32 nt, Human
ugugagccacugcaccuggcagugaugucauu

SEQ ID NO: 530066 - RNA, 32 nt, Human
ugugagccacugcaccuggccaugguuaguug

SEQ ID NO: 530067 - RNA, 32 nt, Human
ugugagccacugcaccuggccccagaaauuau

SEQ ID NO: 530068 - RNA, 32 nt, Human
ugugagccacugcaccuggccuggagcucagu

SEQ ID NO: 530069 - RNA, 32 nt, Human
ugugagccacugccuggccuggccguagguuu

SEQ ID NO: 530070 - RNA, 32 nt, Human
ugugagccacugcgcccagccuauacauguua

SEQ ID NO: 530071 - RNA, 32 nt, Human
ugugagccacugcgccuggacugaguguuugu

SEQ ID NO: 530072 - RNA, 32 nt, Human
ugugagccacugugcccagcaguuucccagaa

SEQ ID NO: 530073 - RNA, 32 nt, Human
ugugagccacugugcccagccuaauugcagua

SEQ ID NO: 530074 - RNA, 32 nt, Human
ugugagccacugugccuggccuccggugagua

SEQ ID NO: 530075 - RNA, 32 nt, Human
ugugagccacuguguccagccuguaacuauua

SEQ ID NO: 530076 - RNA, 32 nt, Human
ugugagccagagagcagaaggaagugagggag

SEQ ID NO: 530077 - RNA, 32 nt, Human
ugugagccagcaccaggcaacccggcccuugu

SEQ ID NO: 530078 - RNA, 32 nt, Human
ugugagccagccuggcccuguacagaugugga

SEQ ID NO: 530079 - RNA, 32 nt, Human
ugugagccaggaauggauuuucuugaaacagc

SEQ ID NO: 530080 - RNA, 32 nt, Human
ugugagcccagccuguggucuucuccguaccc

SEQ ID NO: 530081 - RNA, 18 nt, Human
ugugagcccccugaugcc

SEQ ID NO: 530082 - RNA, 32 nt, Human
ugugagccgcuagugauggagagcagagggag

SEQ ID NO: 530083 - RNA, 32 nt, Human
ugugagccgugugcugcaucugugcuagcuca

SEQ ID NO: 530084 - RNA, 32 nt, Human
ugugagccugcaggaaaguuuaccaaaugcug

SEQ ID NO: 530085 - RNA, 18 nt, Human
ugugugguucugggcuua

SEQ ID NO: 530086 - RNA, 32 nt, Human
ugugugguuggaguucucccuacacaucucgu

SEQ ID NO: 530087 - RNA, 22 nt, Human
uguguguacauauauauacaca

SEQ ID NO: 530088 - RNA, 32 nt, Human
uguguguacgugaccacguucuaucuguucau

SEQ ID NO: 530089 - RNA, 32 nt, Human
uguguguagacagggucccacuguguugcuca

SEQ ID NO: 530090 - RNA, 32 nt, Human
uguguguagagacauaaaggagggugauguga

SEQ ID NO: 530091 - RNA, 32 nt, Human
uguguguagccugucuccuagucugccuaugu

SEQ ID NO: 530092 - RNA, 32 nt, Human
uguguguagggugguagaggccaaggugcugc

SEQ ID NO: 530093 - RNA, 32 nt, Human
uguguguagucucuugguuaaagugaagaaac

SEQ ID NO: 530094 - RNA, 32 nt, Human
uguguguagucucuugguuaaagugaagaaca

SEQ ID NO: 530095 - RNA, 32 nt, Human
uguguguauacaauaugaagaaugaucugaag

SEQ ID NO: 530096 - RNA, 24 nt, Human
uguguguauaugcauaaacauaua

SEQ ID NO: 530097 - RNA, 32 nt, Human
uguguguauauguauguguguaugggugugug

SEQ ID NO: 530098 - RNA, 32 nt, Human
uguguguauauguauguuuugaauauguuuuc

SEQ ID NO: 530099 - RNA, 32 nt, Human
uguguguauguauguauguacuuuagcauuac

SEQ ID NO: 530100 - RNA, 32 nt, Human
uguguguauguguauuuauauguauguaugua

SEQ ID NO: 530101 - RNA, 32 nt, Human
uguguguauuuuuaguagagaugggguuuuac

SEQ ID NO: 530102 - RNA, 32 nt, Human
ugugugucaaagagagugaggaagagaaggag

SEQ ID NO: 530103 - RNA, 32 nt, Human
ugugugucaccccaggaggcugcugcuaugau

SEQ ID NO: 530104 - RNA, 32 nt, Human
ugugugucacuguuuucuugcuuuauagauag

SEQ ID NO: 530105 - RNA, 32 nt, Human
ugugugucagcucugugugggugcucacggga

SEQ ID NO: 530106 - RNA, 32 nt, Human
uguguguccagagugagcaaggauuauguuuu

SEQ ID NO: 530107 - RNA, 32 nt, Human
uguguguccauggcauccggagcgaggcgacu

SEQ ID NO: 530108 - RNA, 32 nt, Human
uguguguccuucugagugucagaggaacggcc

SEQ ID NO: 530109 - RNA, 32 nt, Human
uguguguccuugcccugccugccuguggcucu

SEQ ID NO: 530110 - RNA, 32 nt, Human
ugugugucgcgcguguccgcacuggaggcaua

SEQ ID NO: 530111 - RNA, 29 nt, Human
ugugugucgguguguguggagagggugcu

SEQ ID NO: 530112 - RNA, 32 nt, Human
ugugugucuccuauucucuccucucucucugu

SEQ ID NO: 530113 - RNA, 32 nt, Human
ugugugucucucucagccccugcccaggcuag

SEQ ID NO: 530114 - RNA, 29 nt, Human
ugugugucugugugugugccuggagcugc

SEQ ID NO: 530115 - RNA, 32 nt, Human
ugugugucuuggugcauuggaaaaggagucag

SEQ ID NO: 530116 - RNA, 32 nt, Human
ugugugucuuucuccccgagcuccccuguucc

SEQ ID NO: 530117 - RNA, 32 nt, Human
ugugugugaacaaaugugacuccauauuuauu

SEQ ID NO: 530118 - RNA, 32 nt, Human
ugugugugaacuguuguuucuuugccacaugu

SEQ ID NO: 530119 - RNA, 32 nt, Human
ugugugugaccccuccuggggccaggccgggc

SEQ ID NO: 530120 - RNA, 32 nt, Human
ugugugugacucugcagcuccuggccagcuga

SEQ ID NO: 530121 - RNA, 32 nt, Human
ugugugugacucuggguggaagugcccagccc

SEQ ID NO: 530122 - RNA, 32 nt, Human
ugugugugagagacacacacaaacacauuuca

SEQ ID NO: 530123 - RNA, 32 nt, Human
ugugugugagagagagcccucccacugccagc

SEQ ID NO: 530124 - RNA, 32 nt, Human
ugugugugagccagagggagcugugguaaggg

SEQ ID NO: 530125 - RNA, 32 nt, Human
ugugugugagugugugcgcguaugugcgcaca

SEQ ID NO: 530126 - RNA, 29 nt, Human
ugugugugagugugugugggagagagugu

SEQ ID NO: 530127 - RNA, 32 nt, Human
ugugugugaugggguuuugcucuuguugccca

SEQ ID NO: 530128 - RNA, 32 nt, Human
ugugugugauguccaccauguccuucuguggu

SEQ ID NO: 530129 - RNA, 22 nt, Human
ugugugugcaaacaugugcucu

SEQ ID NO: 530130 - RNA, 32 nt, Human
ugugugugcauaggagaauggcccacuccaaa

SEQ ID NO: 530131 - RNA, 32 nt, Human
ugugugugcaugcacacgcauguauguaucug

SEQ ID NO: 530132 - RNA, 29 nt, Human
ugugugugcaugugugugcaggggugugu

SEQ ID NO: 530133 - RNA, 32 nt, Human
ugugugugcaugugugugucugucuuuguggg

SEQ ID NO: 530134 - RNA, 29 nt, Human
ugugugugcgugugugugauuuggggugu

SEQ ID NO: 530135 - RNA, 32 nt, Human
uguguguggagagcuuucuaucuuaccaagug

SEQ ID NO: 530136 - RNA, 32 nt, Human
ugugugugggaaguggaagcagcaugaagugc

SEQ ID NO: 530137 - RNA, 32 nt, Human
uguguguggggaaaagugcaguauuuaccugu

SEQ ID NO: 530138 - RNA, 32 nt, Human
uguguguggggaggggaagggugugugagugg

SEQ ID NO: 530139 - RNA, 32 nt, Human
uguguguggggaugugugugugggccuaugca

SEQ ID NO: 530140 - RNA, 32 nt, Human
ugugugugggggugugucuguggccagucauu

SEQ ID NO: 530141 - RNA, 32 nt, Human
uguguguggugggcacacauagaacacuugcu

SEQ ID NO: 530142 - RNA, 32 nt, Human
uguguguguaaccucaugguugugcucaggcu

SEQ ID NO: 530143 - RNA, 32 nt, Human
uguguguguaccacugccaucugaacaaacua

SEQ ID NO: 530144 - RNA, 24 nt, Human
uguguguguauauauacucacaua

SEQ ID NO: 530145 - RNA, 24 nt, Human
uguguguguauauauguguauaua

SEQ ID NO: 530146 - RNA, 25 nt, Human
uguguguguaugaaauacacacaua

SEQ ID NO: 530147 - RNA, 32 nt, Human
uguguguguaugggccugaucacacacaaaca

SEQ ID NO: 530148 - RNA, 32 nt, Human
uguguguguauguauaugugugugggugcaca

SEQ ID NO: 530149 - RNA, 32 nt, Human
uguguguguauguguggguguguguuacauac

SEQ ID NO: 530150 - RNA, 29 nt, Human
uguguguguauguguguggguuagggcuu

SEQ ID NO: 530151 - RNA, 29 nt, Human
uguguguguauguguguguuaugggggaa

SEQ ID NO: 530152 - RNA, 32 nt, Human
ugugugugucaggguuggagagcuuugguagg

SEQ ID NO: 530153 - RNA, 32 nt, Human
ugugugugucuaauuugauuuaccucaggugu

SEQ ID NO: 530154 - RNA, 32 nt, Human
ugugugugucucacacacacagcgcgcagugu

SEQ ID NO: 530155 - RNA, 32 nt, Human
ugugugugucugcaccacauacauggacacug

SEQ ID NO: 530156 - RNA, 32 nt, Human
ugugugugucugcauguguguuuguacauaga

SEQ ID NO: 530157 - RNA, 29 nt, Human
ugugugugucugucuggggugauauguuu

SEQ ID NO: 530158 - RNA, 29 nt, Human
ugugugugucuguguaugcaaguguuggu

SEQ ID NO: 530159 - RNA, 29 nt, Human
ugugugugucugugugugucuugggaggg

SEQ ID NO: 530160 - RNA, 29 nt, Human
ugugugugucugugugugugccuggagcu

SEQ ID NO: 530161 - RNA, 32 nt, Human
ugugugugucuuuucuccccaguaauuccuua

SEQ ID NO: 530162 - RNA, 32 nt, Human
ugugugugugaaauuuuaguucugguuuguuu

SEQ ID NO: 530163 - RNA, 32 nt, Human
ugugugugugacugugugugcagagaugugug

SEQ ID NO: 530164 - RNA, 32 nt, Human
ugugugugugagagacacacacaaacacauuu

SEQ ID NO: 530165 - RNA, 32 nt, Human
ugugugugugagugugugugggagagagugug

SEQ ID NO: 530166 - RNA, 18 nt, Human
ugugugugugcacacaca

SEQ ID NO: 530167 - RNA, 21 nt, Human
ugugugugugcacacacacag

SEQ ID NO: 530168 - RNA, 18 nt, Human
ugugugugugcgcacaca

SEQ ID NO: 530169 - RNA, 32 nt, Human
ugugugugugcgugugcacgugcacacaugug

SEQ ID NO: 530170 - RNA, 32 nt, Human
uguguguguggguggucacaggagagugugag

SEQ ID NO: 530171 - RNA, 32 nt, Human
uguguguguggguggucacaggagggugugag

SEQ ID NO: 530172 - RNA, 32 nt, Human
ugugugugugggugugcacgugcacacaugug

SEQ ID NO: 530173 - RNA, 32 nt, Human
uguguguguugaccaucacugccaucacauca

SEQ ID NO: 530174 - RNA, 32 nt, Human
uguguguguuuccuuauugucauuccauuaua

SEQ ID NO: 530175 - RNA, 32 nt, Human
uguguguguuugaaugaaaaaugcuuauguau

SEQ ID NO: 530176 - RNA, 32 nt, Human
uguguguguuugcucuucgcagccucuugagc

SEQ ID NO: 530177 - RNA, 29 nt, Human
uguguguguuuguguguguauaccugaca

SEQ ID NO: 530178 - RNA, 32 nt, Human
uguguguucagggacugagccuggggacgccc

SEQ ID NO: 530179 - RNA, 32 nt, Human
uguguguucaucuacccaugaggaauaaaacc

SEQ ID NO: 530180 - RNA, 32 nt, Human
uguguguucuuccguuucuuccuugucgcucu

SEQ ID NO: 530181 - RNA, 32 nt, Human
uguguguugcaugagcaugcaugcgugcgagu

SEQ ID NO: 530182 - RNA, 32 nt, Human
uguguguuucaggcuuggaguguaugaguggu

SEQ ID NO: 530183 - RNA, 32 nt, Human
uguguguuucuguauaugcacacacauaaacg

SEQ ID NO: 530184 - RNA, 32 nt, Human
uguguguuugggcccggauggucagggugggg

SEQ ID NO: 530185 - RNA, 32 nt, Human
uguguguuuguggggagagggaaggaggaagu

SEQ ID NO: 530186 - RNA, 32 nt, Human
uguguguuuuaacagcaugacuucuuacagag

SEQ ID NO: 530187 - RNA, 32 nt, Human
uguguguuuuaaggucuugcucugucacuugg

SEQ ID NO: 530188 - RNA, 32 nt, Human
uguguuaaaaagaaauuugcaacugugaauaa

SEQ ID NO: 530189 - RNA, 32 nt, Human
uguguuaaaauuacaaugaucuuuuaaaaaga

SEQ ID NO: 530190 - RNA, 32 nt, Human
uguguuaaacuguuuagugcucuguuuuuaag

SEQ ID NO: 530191 - RNA, 32 nt, Human
uguguuaacucaggaugccaaguggcccucag

SEQ ID NO: 530192 - RNA, 32 nt, Human
uguguuaacugcuggaagggacagaugcacug

SEQ ID NO: 530193 - RNA, 22 nt, Human
uguguuaagcaagaacuacaga

SEQ ID NO: 530194 - RNA, 32 nt, Human
uguguuaaucuuugcaucauauuggacucuug

SEQ ID NO: 530195 - RNA, 32 nt, Human
uguguuacaugguaauaaagccaaugaagaga

SEQ ID NO: 530196 - RNA, 32 nt, Human
uguguuacccaggaugcagcaggugugugcag

SEQ ID NO: 530197 - RNA, 32 nt, Human
uguguuacuaguggccccaguauaccugggau

SEQ ID NO: 530198 - RNA, 32 nt, Human
uguguuacuccuaaggacuuuugggauuuuga

SEQ ID NO: 530199 - RNA, 32 nt, Human
uguguuacugaccaauguggagcugggucuag

SEQ ID NO: 530200 - RNA, 32 nt, Human
uguguuacugugggaaccuuuccucuuaaugc

SEQ ID NO: 530201 - RNA, 32 nt, Human
uguguuagaaaugcaguugccauaggaguaac

SEQ ID NO: 530202 - RNA, 32 nt, Human
uguguuagaugacgugccaccuccucaggaaa

SEQ ID NO: 530203 - RNA, 32 nt, Human
uguguuaggugcugggaguacagugaaaggca

SEQ ID NO: 530204 - RNA, 32 nt, Human
uguguuaguccacaccuguggucccagcugcc

SEQ ID NO: 530205 - RNA, 32 nt, Human
uguguuagucucaggcccuccuggaccacguu

SEQ ID NO: 530206 - RNA, 32 nt, Human
uguguuagucuuccugcagcugagcuuccaca

SEQ ID NO: 530207 - RNA, 32 nt, Human
uguguuauaaguaacacagaagaagaauggau

SEQ ID NO: 530208 - RNA, 32 nt, Human
uguguuauacaguuuaaaaagccugcaaaagu

SEQ ID NO: 530209 - RNA, 20 nt, Human
uguguuauauaaacauaaua

SEQ ID NO: 530210 - RNA, 32 nt, Human
uguguucaaaggcuugauggcagaugggagcc

SEQ ID NO: 530211 - RNA, 32 nt, Human
uguguucaacauguguuacaagcauggguucu

SEQ ID NO: 530212 - RNA, 32 nt, Human
uguguucaagcagaucugauguccucgccugu

SEQ ID NO: 530213 - RNA, 32 nt, Human
uguguucaauuauuaccaucacagccuuuuaa

SEQ ID NO: 530214 - RNA, 32 nt, Human
uguguucacaauggauaggcacaggaaaccag

SEQ ID NO: 530215 - RNA, 32 nt, Human
uguguucacaccacugcacuccagucugggca

SEQ ID NO: 530216 - RNA, 32 nt, Human
uguguucacaucuucgcucuggccagcccauu

SEQ ID NO: 530217 - RNA, 32 nt, Human
uguguucacaugugccuuccguccagagcagu

SEQ ID NO: 530218 - RNA, 32 nt, Human
uguguucaccugcucguccuggcuugggcccc

SEQ ID NO: 530219 - RNA, 32 nt, Human
uguguucagcugugggcaauauaaugggugga

SEQ ID NO: 530220 - RNA, 32 nt, Human
uguguucaggcuccugagcacggcuucccuuu

SEQ ID NO: 530221 - RNA, 32 nt, Human
uguguucaggggucuugccuccaggaugaaaa

SEQ ID NO: 530222 - RNA, 32 nt, Human
uguguucaguuagagucguggaaaaaucccug

SEQ ID NO: 530223 - RNA, 32 nt, Human
uguguucaguugaauuguaacugcuuuuugua

SEQ ID NO: 530224 - RNA, 32 nt, Human
uguguucauauauggacauggaaauauuuaua

SEQ ID NO: 530225 - RNA, 32 nt, Human
uguguucaucaaauacuccuuucagagcuguu

SEQ ID NO: 530226 - RNA, 32 nt, Human
uguguucaugccacugcacuuccagccugggu

SEQ ID NO: 530227 - RNA, 19 nt, Human
uguguucauuaucccuaca

SEQ ID NO: 530228 - RNA, 32 nt, Human
uguguuccaggagugguggcucugagguguga

SEQ ID NO: 530229 - RNA, 32 nt, Human
uguguuccaggaugagacaucuggaggugagc

SEQ ID NO: 530230 - RNA, 32 nt, Human
uguguuccaguaaaaccacaaaaacaggcagc

SEQ ID NO: 530231 - RNA, 32 nt, Human
uguguucccacagacagaaacgccugccccug

SEQ ID NO: 530232 - RNA, 32 nt, Human
uguguucccggcugugugauccugggcaagaa

SEQ ID NO: 530233 - RNA, 32 nt, Human
uguguucccgugucugucugucuugcaucccu

SEQ ID NO: 530234 - RNA, 18 nt, Human
uguguuccuacugggcuu

SEQ ID NO: 530235 - RNA, 32 nt, Human
uguguuccugaagcguccagcacuccggcgag

SEQ ID NO: 530236 - RNA, 32 nt, Human
uguguuccugcagcgucugguguuguccccag

SEQ ID NO: 530237 - RNA, 32 nt, Human
uguguuccugcucuggcccccguggggcuggg

SEQ ID NO: 530238 - RNA, 32 nt, Human
uguguuccuguauuguggccuggugccauuuu

SEQ ID NO: 530239 - RNA, 32 nt, Human
uguguucgcaccacugcacuccagccugggug

SEQ ID NO: 530240 - RNA, 32 nt, Human
uguguucgguccuucaggcucuccuuuaaaag

SEQ ID NO: 530241 - RNA, 32 nt, Human
uguguucucaaaggcaaauccuaucacccacu

SEQ ID NO: 530242 - RNA, 32 nt, Human
uguguucugagcaaccuuuccccgaacacaca

SEQ ID NO: 530243 - RNA, 32 nt, Human
uguguucugaguggaaguacagccuggaaagu

SEQ ID NO: 530244 - RNA, 32 nt, Human
uguguucugcuaugguccacaggcuggagggu

SEQ ID NO: 530245 - RNA, 32 nt, Human
uguguucugcuccauaccuuuucucuuuucuu

SEQ ID NO: 530246 - RNA, 32 nt, Human
uguguucugcuccauacuuuuucucuuuucuu

SEQ ID NO: 530247 - RNA, 32 nt, Human
uguguucuggaauuuucugccucacagcaaau

SEQ ID NO: 530248 - RNA, 32 nt, Human
uguguucugggcaccaccgugacccugcccag

SEQ ID NO: 530249 - RNA, 32 nt, Human
uguguucugguaaucgugcagaacagcaugug

SEQ ID NO: 530250 - RNA, 32 nt, Human
uguguucuguuaauguaagacgaugaacaguu

SEQ ID NO: 530251 - RNA, 20 nt, Human
uguguucuuauuaaacaaug

SEQ ID NO: 530252 - RNA, 32 nt, Human
uguguucuucaaaaugauguugaagucccagu

SEQ ID NO: 530253 - RNA, 32 nt, Human
uguguucuucauugaugcuguacuccugaaaa

SEQ ID NO: 530254 - RNA, 32 nt, Human
uguguucuucuuucucuguauuccgauacaaa

SEQ ID NO: 530255 - RNA, 32 nt, Human
uguguucuuggaguauuucacacugaggacua

SEQ ID NO: 530256 - RNA, 32 nt, Human
uguguucuuguaggaagaucuguugaaauucc

SEQ ID NO: 530257 - RNA, 32 nt, Human
uguguugaagauggcaaagccacaagauggaa

SEQ ID NO: 530258 - RNA, 32 nt, Human
uguguugagagauacuuagagggagggaguag

SEQ ID NO: 530259 - RNA, 32 nt, Human
uguguugagcacaaggggaagaaugaacacag

SEQ ID NO: 530260 - RNA, 32 nt, Human
uguguugagucaaggcaggaugacaguucagc

SEQ ID NO: 530261 - RNA, 32 nt, Human
uguguugcaaggagcccuccugccugggagcu

SEQ ID NO: 530262 - RNA, 32 nt, Human
uguguugcagggaagcaaucagaggaaaucuc

SEQ ID NO: 530263 - RNA, 32 nt, Human
uguguugcaggguggagaaguggggagaagug

SEQ ID NO: 530264 - RNA, 32 nt, Human
uguguugccacuuuccaagucacugcaaaacc

SEQ ID NO: 530265 - RNA, 32 nt, Human
uguguugccaggcaggcaccugggcuuucugg

SEQ ID NO: 530266 - RNA, 32 nt, Human
uguguugcccaggcuggagugcaguggccugg

SEQ ID NO: 530267 - RNA, 32 nt, Human
uguguugcccaggcuggagugcagugguguga

SEQ ID NO: 530268 - RNA, 32 nt, Human
uguguugcccaggcuggagugcgguggcuauu

SEQ ID NO: 530269 - RNA, 32 nt, Human
uguguugcccccacccuggcugccugcuaagg

SEQ ID NO: 530270 - RNA, 32 nt, Human
uguguugccuccucccugucugacucuuccuc

SEQ ID NO: 530271 - RNA, 32 nt, Human
uguguugccugggauuccuuucccuccacccu

SEQ ID NO: 530272 - RNA, 32 nt, Human
uguguugcucacugcagugggcccagccuggu

SEQ ID NO: 530273 - RNA, 32 nt, Human
uguguugcucaggcuggagugcagugguguga

SEQ ID NO: 530274 - RNA, 32 nt, Human
uguguuggaacaccaagguugcaugagcugau

SEQ ID NO: 530275 - RNA, 32 nt, Human
uguguuggacccauccuugccccgcugugccu

SEQ ID NO: 530276 - RNA, 32 nt, Human
uguguuggagccacacgguuggacagguuccc

SEQ ID NO: 530277 - RNA, 32 nt, Human
uguguuggcacacgccuguaauaccagcuacu

SEQ ID NO: 530278 - RNA, 32 nt, Human
uguguuggcacgugccuguaaucccaguuacu

SEQ ID NO: 530279 - RNA, 32 nt, Human
uguguugggagaaacuuugugaaugcaccauu

SEQ ID NO: 530280 - RNA, 32 nt, Human
uguguugggagcagaggaguccuacuccuugc

SEQ ID NO: 530281 - RNA, 32 nt, Human
uguguugggaguauguauucacacacauacau

SEQ ID NO: 530282 - RNA, 32 nt, Human
uguguugggauuacaggcgugaaccaccgcgc

SEQ ID NO: 530283 - RNA, 32 nt, Human
uguguuggugcaugcuuauaaucccagcuacu

SEQ ID NO: 530284 - RNA, 32 nt, Human
uguguuggugcuuuagcgauugauugauguac

SEQ ID NO: 530285 - RNA, 32 nt, Human
uguguugguggcacauuggauauuucuaacau

SEQ ID NO: 530286 - RNA, 32 nt, Human
uguguuggugggcaccuguaaucccaccuacu

SEQ ID NO: 530287 - RNA, 32 nt, Human
uguguuggugggccccuguaaucccagcuacu

SEQ ID NO: 530288 - RNA, 32 nt, Human
uguguuggugggguaaggcaucaggaaaaaug

SEQ ID NO: 530289 - RNA, 32 nt, Human
uguguuggugugcaccuguaaucccagcuacu

SEQ ID NO: 530290 - RNA, 32 nt, Human
uguguuguaccacugcacuccagccuggguga

SEQ ID NO: 530291 - RNA, 32 nt, Human
uguguuguccaggcuggagugcagugguguga

SEQ ID NO: 530292 - RNA, 32 nt, Human
uguguugucugcuacccucauccuggucacug

SEQ ID NO: 530293 - RNA, 32 nt, Human
uguguugugacuccugaggucucucagcucuc

SEQ ID NO: 530294 - RNA, 32 nt, Human
uguguugugggaggggaugggaggcgccccuc

SEQ ID NO: 530295 - RNA, 32 nt, Human
uguguuguguuaauucuuucucauguugggag

SEQ ID NO: 530296 - RNA, 32 nt, Human
uguguuguuauccagggcuccagacuuccucc

SEQ ID NO: 530297 - RNA, 32 nt, Human
uguguuguuuaaaaugcggcugcucugcuucc

SEQ ID NO: 530298 - RNA, 32 nt, Human
uguguuguuucuuggaaaguuuuguaaaauua

SEQ ID NO: 530299 - RNA, 32 nt, Human
uguguuuaagaaaaggaggacugaaggacaaa

SEQ ID NO: 530300 - RNA, 32 nt, Human
uguguuuaagaugcagauuacaggugugagcc

SEQ ID NO: 530301 - RNA, 32 nt, Human
uguguuuacauacacucgugcuuuuccuuauc

SEQ ID NO: 530302 - RNA, 32 nt, Human
uguguuuacuguguccuugcucuccuuccuug

SEQ ID NO: 530303 - RNA, 32 nt, Human
uguguuucaaaaccaugccugguauuuucaac

SEQ ID NO: 530304 - RNA, 32 nt, Human
uguguuucaaagcugcucaaucaaaagaaagg

SEQ ID NO: 530305 - RNA, 32 nt, Human
uguguuucaaauuaugcauuccaggcucuagu

SEQ ID NO: 530306 - RNA, 32 nt, Human
uguguuucagcccaaagcagcaaauggaaucc

SEQ ID NO: 530307 - RNA, 32 nt, Human
uguguuucagcccuggaauugccacauucucc

SEQ ID NO: 530308 - RNA, 32 nt, Human
uguguuucagugacugauaaacaaaaaugaag

SEQ ID NO: 530309 - RNA, 32 nt, Human
uguguuucauaaugacuuuuaacugguaaaaa

SEQ ID NO: 530310 - RNA, 32 nt, Human
uguguuucauguuucaccuaagucauaaauaa

SEQ ID NO: 530311 - RNA, 32 nt, Human
uguguuucauucugaucuuucauucauauaua

SEQ ID NO: 530312 - RNA, 32 nt, Human
uguguuucauucugucucaaaaaucacauuuu

SEQ ID NO: 530313 - RNA, 32 nt, Human
uguguuuccagcccugugcugggccuguagag

SEQ ID NO: 530314 - RNA, 32 nt, Human
uguguuuccagggggugcugggggaaggguuc

SEQ ID NO: 530315 - RNA, 32 nt, Human
uguguuuccaucucaaagaaggcauuugcagg

SEQ ID NO: 530316 - RNA, 32 nt, Human
uguguuuccauucuaagauugagucuggcagu

SEQ ID NO: 530317 - RNA, 32 nt, Human
uguguuucccagccucuccacucccccgccag

SEQ ID NO: 530318 - RNA, 32 nt, Human
uguguuucgccacugcacaccagccuggguga

SEQ ID NO: 530319 - RNA, 32 nt, Human
uguguuucuagagugagauuuguguuuucugc

SEQ ID NO: 530320 - RNA, 32 nt, Human
uguguuucucacuggaggcuggaaugaaugau

SEQ ID NO: 530321 - RNA, 32 nt, Human
uguguuucuuaaucuucccuucugccuuguuc

SEQ ID NO: 530322 - RNA, 21 nt, Human
uguguuugacagagaugggga

SEQ ID NO: 530323 - RNA, 32 nt, Human
uguguuugaggcaccagguuugagugcuggga

SEQ ID NO: 530324 - RNA, 32 nt, Human
uguguuugcaaauaggcuccauuuuccauguu

SEQ ID NO: 530325 - RNA, 32 nt, Human
uguguuugcaucacugcacuccagccugggca

SEQ ID NO: 530326 - RNA, 32 nt, Human
uguguuugcauuccacugcucugcucccuaag

SEQ ID NO: 530327 - RNA, 32 nt, Human
uguguuugccuaaccuucauugcagugggcag

SEQ ID NO: 530328 - RNA, 32 nt, Human
uguguuugccuaggagagugugugugggcagc

SEQ ID NO: 530329 - RNA, 32 nt, Human
uguguuugcuacacugaccucuugcggucuug

SEQ ID NO: 530330 - RNA, 32 nt, Human
uguguuuggaagcaagggacuccgaguuguga

SEQ ID NO: 530331 - RNA, 32 nt, Human
uguguuuggaagcuucagcccugcacauuuga

SEQ ID NO: 530332 - RNA, 32 nt, Human
uguguuuggcaauauuacugugccaaaaauca

SEQ ID NO: 530333 - RNA, 32 nt, Human
uguguuugggaagugggugaggcugggcaggg

SEQ ID NO: 530334 - RNA, 32 nt, Human
uguguuuggucugcccuggaggugcugggccc

SEQ ID NO: 530335 - RNA, 32 nt, Human
uguguuuguguaugucuguguauguaaguuug

SEQ ID NO: 530336 - RNA, 32 nt, Human
uguguuuguguaugugucuguguguguauuca

SEQ ID NO: 530337 - RNA, 32 nt, Human
uguguuuguguguguauaccugacauauauag

SEQ ID NO: 530338 - RNA, 32 nt, Human
uguguuuguuaacaacccuuuaucucuuagug

SEQ ID NO: 530339 - RNA, 29 nt, Human
uguguuuguuugugugugucugugugugc

SEQ ID NO: 530340 - RNA, 32 nt, Human
uguguuuuaagugcccagugaacacaguucca

SEQ ID NO: 530341 - RNA, 32 nt, Human
uguguuuuacccagcaccuccggacacucacc

SEQ ID NO: 530342 - RNA, 32 nt, Human
uguguuuuagugaaucugcucucccagcucac

SEQ ID NO: 530343 - RNA, 32 nt, Human
uguguuuuagugggaacaccaaaguuugccua

SEQ ID NO: 530344 - RNA, 32 nt, Human
uguguuuucaaauguguauagaugcuauuguu

SEQ ID NO: 530345 - RNA, 32 nt, Human
uguguuuucaagcccucuacuucucuuuccag

SEQ ID NO: 530346 - RNA, 22 nt, Human
uguguuuucucgaauuuugcca

SEQ ID NO: 530347 - RNA, 32 nt, Human
uguguuuucugcccuuuuccucuccagccaau

SEQ ID NO: 530348 - RNA, 32 nt, Human
uguguuuucuucugugugaaguacgugagcuu

SEQ ID NO: 530349 - RNA, 32 nt, Human
uguguuuucuuuucuuuuguuuuuggcugucu

SEQ ID NO: 530350 - RNA, 32 nt, Human
uguguuuugcucugucuaaaaacaucugcaua

SEQ ID NO: 530351 - RNA, 32 nt, Human
uguguuuugggauguguccuagcauuuacaag

SEQ ID NO: 530352 - RNA, 19 nt, Human
uguguuuuguuuugauuug

SEQ ID NO: 530353 - RNA, 32 nt, Human
uguguuuuuaaagaaguauaagggaaaaggaa

SEQ ID NO: 530354 - RNA, 32 nt, Human
uguguuuuuccucugcuguguucugugugucc

SEQ ID NO: 530355 - RNA, 32 nt, Human
uguguuuuucugcuuuguucgcucuuacuucu

SEQ ID NO: 530356 - RNA, 32 nt, Human
uguguuuuugagacagggucgcacucugucgc

SEQ ID NO: 530357 - RNA, 32 nt, Human
uguguuuuugagacggagucucgcucugucgg

SEQ ID NO: 530358 - RNA, 32 nt, Human
uguguuuuugagacggggucgcacucugucgc

SEQ ID NO: 530359 - RNA, 32 nt, Human
uguguuuuugcagugccaauuugcauuuucug

SEQ ID NO: 530360 - RNA, 32 nt, Human
uguuaaaaagaaauuugcaacugugaauaaaa

SEQ ID NO: 530361 - RNA, 32 nt, Human
uguuaaaaaggcugcacugacaugguuaaauu

SEQ ID NO: 530362 - RNA, 32 nt, Human
uguuaaaaaugugaauuucuugaaugaauuuc

SEQ ID NO: 530363 - RNA, 32 nt, Human
uguuaaaaccagcuguccuguucuccaucucc

SEQ ID NO: 530364 - RNA, 32 nt, Human
uguuaaaaucucaagaaaauuucacagagcua

SEQ ID NO: 530365 - RNA, 32 nt, Human
uguuaaaauuagagguaguaaaaugacacauu

SEQ ID NO: 530366 - RNA, 32 nt, Human
uguuaaacaaaugcuugaaggcagcaugcuug

SEQ ID NO: 530367 - RNA, 32 nt, Human
uguuaaacagaugcuugaaggcagcaugcucc

SEQ ID NO: 530368 - RNA, 32 nt, Human
uguuaaacagaugcuugaaggcagcaugcucg

SEQ ID NO: 530369 - RNA, 22 nt, Human
uguuaaacagucuccggugccc

SEQ ID NO: 530370 - RNA, 32 nt, Human
uguuaaacauuuugaguuaucuucccagguug

SEQ ID NO: 530371 - RNA, 32 nt, Human
uguuaaagauuuuucaaugacacuuguucaag

SEQ ID NO: 530372 - RNA, 32 nt, Human
uguuaaagccaaaacccagcucugagggccuu

SEQ ID NO: 530373 - RNA, 32 nt, Human
uguuaaagcuaaauuuauuuugcuucccucca

SEQ ID NO: 530374 - RNA, 32 nt, Human
uguuaaaggaugaugcuuugccuauguaauag

SEQ ID NO: 530375 - RNA, 32 nt, Human
uguuaaagguguuuuguuuucuuaauugauac

SEQ ID NO: 530376 - RNA, 32 nt, Human
uguuaaagucaaaggcugcaguaugucuauau

SEQ ID NO: 530377 - RNA, 32 nt, Human
uguuaaaguccauugggccucccaggccccuc

SEQ ID NO: 530378 - RNA, 32 nt, Human
uguuaaauagaaacugaauguacuggguugaa

SEQ ID NO: 530379 - RNA, 32 nt, Human
uguuaaaucagaaaugugaauguaguaagggg

SEQ ID NO: 530380 - RNA, 32 nt, Human
uguuaaauccaguauggccacaggaggagguc

SEQ ID NO: 530381 - RNA, 32 nt, Human
uguuaaaugccauuaggcaccaacuuaaagag

SEQ ID NO: 530382 - RNA, 32 nt, Human
uguuaacacaaaagggcaucaccaucccacga

SEQ ID NO: 530383 - RNA, 32 nt, Human
uguuaacacagcuguggcucguuugagggauu

SEQ ID NO: 530384 - RNA, 32 nt, Human
uguuaacagaugucagagugauucucaccaaa

SEQ ID NO: 530385 - RNA, 32 nt, Human
uguuaacaugugcuuagucuucccucuuucuc

SEQ ID NO: 530386 - RNA, 32 nt, Human
uguuaacauugagacucuggccccagauuggu

SEQ ID NO: 530387 - RNA, 32 nt, Human
uguuaacauuuuucuuucugcagagaggaaga

SEQ ID NO: 530388 - RNA, 32 nt, Human
uguuaaccagaggcugcucuucccaggcugcu

SEQ ID NO: 530389 - RNA, 32 nt, Human
uguuaaccaugguggggacagccuucuucaug

SEQ ID NO: 530390 - RNA, 32 nt, Human
uguuaacgacaggcucuguuguauguguuacu

SEQ ID NO: 530391 - RNA, 32 nt, Human
uguuaacuaagcauugugcuucccaggugguc

SEQ ID NO: 530392 - RNA, 32 nt, Human
uguuaacucauuuuauccauuccuuacauaau

SEQ ID NO: 530393 - RNA, 32 nt, Human
uguuaacucuugccguaucaggagacugaaag

SEQ ID NO: 530394 - RNA, 32 nt, Human
uguuaacucuuucugcuccuugcauuuugaca

SEQ ID NO: 530395 - RNA, 32 nt, Human
uguuaacugagugccuuuugguggagaggccc

SEQ ID NO: 530396 - RNA, 32 nt, Human
uguuaacuggccugcauggggucacacaguga

SEQ ID NO: 530397 - RNA, 32 nt, Human
uguuaacuuuuaagcauuucacaaacaacauu

SEQ ID NO: 530398 - RNA, 32 nt, Human
uguuaagaaugacauucagugcagccucuuua

SEQ ID NO: 530399 - RNA, 32 nt, Human
uguuaagagccaguucuuagaagaaccuaugc

SEQ ID NO: 530400 - RNA, 32 nt, Human
uguuaagaugaauuaucuccuaaaaauaucau

SEQ ID NO: 530401 - RNA, 32 nt, Human
uguuaagcaaacauccauaguaaaacaaauaa

SEQ ID NO: 530402 - RNA, 32 nt, Human
uguuaagcacacauacuuuagaugugugcucc

SEQ ID NO: 530403 - RNA, 32 nt, Human
uguuaagcagaagggagagaguccuuacuccc

SEQ ID NO: 530404 - RNA, 32 nt, Human
uguuaagccuuggcucuggauguggccuagau

SEQ ID NO: 530405 - RNA, 32 nt, Human
uguuaagcuacugcuguuuucuuucuguuauu

SEQ ID NO: 530406 - RNA, 32 nt, Human
uguuaaggaaauucaucucuuguuuuaucaga

SEQ ID NO: 530407 - RNA, 32 nt, Human
uguuaaggaaauucaucucuuguuuuaucagg

SEQ ID NO: 530408 - RNA, 32 nt, Human
uguuaaggauuuucacucucuuucacugggcu

SEQ ID NO: 530409 - RNA, 32 nt, Human
uguuaaggggagacuaggcucccuggacuagg

SEQ ID NO: 530410 - RNA, 32 nt, Human
uguuaaggguaagcuuguaauaccucaccagu

SEQ ID NO: 530411 - RNA, 32 nt, Human
uguuaaggguguugucucugucaccucuucaa

SEQ ID NO: 530412 - RNA, 32 nt, Human
uguuaagguuccaaacugugcuacagauacuu

SEQ ID NO: 530413 - RNA, 32 nt, Human
uguuaagugcaacaacaucacaguagagcuac

SEQ ID NO: 530414 - RNA, 31 nt, Human
uguuaauaaaugggcuuaauguuaacaugga

SEQ ID NO: 530415 - RNA, 32 nt, Human
uguuaauacaauacguuucuacuuucccugau

SEQ ID NO: 530416 - RNA, 32 nt, Human
uguuaauauuugaauugccuugcuuuuaucac

SEQ ID NO: 530417 - RNA, 32 nt, Human
uguuaaucuaaucaaguuugcuguuaguugug

SEQ ID NO: 530418 - RNA, 32 nt, Human
uguuaaucucagagacaguauuucaagagagu

SEQ ID NO: 530419 - RNA, 32 nt, Human
uguuaaugaaagugccugaaagaccuuccuua

SEQ ID NO: 530420 - RNA, 32 nt, Human
uguuaaugaacaagucuucuucugguaagagc

SEQ ID NO: 530421 - RNA, 32 nt, Human
uguuaaugagaugguauuguaaaagaguugca

SEQ ID NO: 530422 - RNA, 32 nt, Human
uguuaaugaugcuccugccucugccucccagc

SEQ ID NO: 530423 - RNA, 32 nt, Human
uguuaaugccaucaauccucuaggaaggaauu

SEQ ID NO: 530424 - RNA, 31 nt, Human
uguuaaugcgggcagcaccuacagcaacuug

SEQ ID NO: 530425 - RNA, 32 nt, Human
uguuaaugcuacuggucuaacuucauucagua

SEQ ID NO: 530426 - RNA, 32 nt, Human
uguuaaugcuuuguuaaugcuuuucccacucu

SEQ ID NO: 530427 - RNA, 30 nt, Human
uguuaauggaaagaggaaagaagaaaagaa

SEQ ID NO: 530428 - RNA, 32 nt, Human
uguuaauggaagcaaggcaccuguugaaggaa

SEQ ID NO: 530429 - RNA, 32 nt, Human
uguuaauguguagaguucuccuuucucgaaau

SEQ ID NO: 530430 - RNA, 32 nt, Human
uguuaauuguucaaacuuucugccuucuacau

SEQ ID NO: 530431 - RNA, 32 nt, Human
uguuaauuugcucaaaauacaauguuugauuu

SEQ ID NO: 530432 - RNA, 32 nt, Human
uguuaauuuguggaguaggggaaagguucugc

SEQ ID NO: 530433 - RNA, 32 nt, Human
uguuacaaaaggcaugagaaugaauguugucg

SEQ ID NO: 530434 - RNA, 32 nt, Human
uguuacaaaauguaacuguuaccauuggaaau

SEQ ID NO: 530435 - RNA, 32 nt, Human
uguuacacacuauuuuggaauuagagaacaua

SEQ ID NO: 530436 - RNA, 32 nt, Human
uguuacacuagaaaauuauuucagucuucaaa

SEQ ID NO: 530437 - RNA, 32 nt, Human
uguuacagaaacagagggcuguuucuuuuugu

SEQ ID NO: 530438 - RNA, 32 nt, Human
uguuacagacgggguuucaccauguuggcugg

SEQ ID NO: 530439 - RNA, 24 nt, Human
uguuacagacucuguuuucugccu

SEQ ID NO: 530440 - RNA, 32 nt, Human
uguuacagaggacccuuacgugagaaauagcu

SEQ ID NO: 530441 - RNA, 32 nt, Human
uguuacagaguuucagaucggucacugauagu

SEQ ID NO: 530442 - RNA, 32 nt, Human
uguuacagauggugaaccgaaacuuacagagc

SEQ ID NO: 530443 - RNA, 32 nt, Human
uguuacagcccauaacagcugcagccuugacu

SEQ ID NO: 530444 - RNA, 32 nt, Human
uguuacaggagaagagucaccuggaaaauaag

SEQ ID NO: 530445 - RNA, 32 nt, Human
uguuacagggagcauggucuguugaagauuuu

SEQ ID NO: 530446 - RNA, 32 nt, Human
uguuacaggggugcuggccuucccuggcgccu

SEQ ID NO: 530447 - RNA, 32 nt, Human
uguuacagggugaccuguucucuagcugugau

SEQ ID NO: 530448 - RNA, 32 nt, Human
uguuacagugagaccuguguucgguggaagcc

SEQ ID NO: 530449 - RNA, 32 nt, Human
uguuacaguucugcaaagguaaccuggaguuu

SEQ ID NO: 530450 - RNA, 20 nt, Human
uguuacaugaacaugugcau

SEQ ID NO: 530451 - RNA, 32 nt, Human
uguuacaugagagacaucaaucagguucucuu

SEQ ID NO: 530452 - RNA, 32 nt, Human
uguuacauguacagaacuuugucuacagcaca

SEQ ID NO: 530453 - RNA, 32 nt, Human
uguuacauuuuccugcaacucugccuucuuga

SEQ ID NO: 530454 - RNA, 32 nt, Human
uguuaccaaauggugucaguauggaccaauug

SEQ ID NO: 530455 - RNA, 32 nt, Human
uguuaccaacaacagcagacuucuacauguac

SEQ ID NO: 530456 - RNA, 32 nt, Human
uguuaccaaugccucagcaaccacugaaaguu

SEQ ID NO: 530457 - RNA, 32 nt, Human
uguuaccacuuccugaaucaguuauuauuucu

SEQ ID NO: 530458 - RNA, 32 nt, Human
uguuaccaguaggaggaggaugagccacagaa

SEQ ID NO: 530459 - RNA, 32 nt, Human
uguuaccauauuuuguauucuggaccacuuac

SEQ ID NO: 530460 - RNA, 32 nt, Human
uguuaccauugccuuuuucuguugagaaauug

SEQ ID NO: 530461 - RNA, 32 nt, Human
uguuacccaagugucuuauacaagcuucuggu

SEQ ID NO: 530462 - RNA, 24 nt, Human
uguuacccagauuggagugcagug

SEQ ID NO: 530463 - RNA, 24 nt, Human
uguuacccagccuggagugcagug

SEQ ID NO: 530464 - RNA, 23 nt, Human
uguuacccaggccggagugcagu

SEQ ID NO: 530465 - RNA, 24 nt, Human
uguuacccaggccggagugcagug

SEQ ID NO: 530466 - RNA, 24 nt, Human
uguuacccaggcuagaguguagug

SEQ ID NO: 530467 - RNA, 24 nt, Human
uguuacccaggcuccagugcagug

SEQ ID NO: 530468 - RNA, 24 nt, Human
uguuacccaggcuggaauacagug

SEQ ID NO: 530469 - RNA, 23 nt, Human
uguuacccaggcuggaaugcagu

SEQ ID NO: 530470 - RNA, 24 nt, Human
uguuacccaggcuggaaugcagug

SEQ ID NO: 530471 - RNA, 24 nt, Human
uguuacccaggcuggaggacagug

SEQ ID NO: 530472 - RNA, 23 nt, Human
uguuacccaggcuggaguacagu

SEQ ID NO: 530473 - RNA, 24 nt, Human
uguuacccaggcuggaguacagug

SEQ ID NO: 530474 - RNA, 23 nt, Human
uguuacccaggcuggagugcaau

SEQ ID NO: 530475 - RNA, 24 nt, Human
uguuacccaggcuggagugcaaug

SEQ ID NO: 530476 - RNA, 23 nt, Human
uguuacccaggcuggagugcagu

SEQ ID NO: 530477 - RNA, 24 nt, Human
uguuacccaggcuggagugcagug

SEQ ID NO: 530478 - RNA, 32 nt, Human
uguuacccaggcuggucucacacuccuggccu

SEQ ID NO: 530479 - RNA, 21 nt, Human
uguuacccaggguggauugca

SEQ ID NO: 530480 - RNA, 24 nt, Human
uguuacccaugcuggaguacggug

SEQ ID NO: 530481 - RNA, 32 nt, Human
uguuacccaugguguucuuuguuccuuuucau

SEQ ID NO: 530482 - RNA, 32 nt, Human
uguuaccccacccagcccacguguccaaauac

SEQ ID NO: 530483 - RNA, 32 nt, Human
uguuaccccauccucccucccccagccaccac

SEQ ID NO: 530484 - RNA, 32 nt, Human
uguuacccuucaguaaguucuccccauuuuag

SEQ ID NO: 530485 - RNA, 32 nt, Human
uguuaccgccgcucagcgccccggcugggcgg

SEQ ID NO: 530486 - RNA, 21 nt, Human
uguuaccuagcuucccucuac

SEQ ID NO: 530487 - RNA, 32 nt, Human
uguuaccugcccacccucauccuuaccuccuc

SEQ ID NO: 530488 - RNA, 32 nt, Human
uguuaccugccugucucucccagcuucuuccc

SEQ ID NO: 530489 - RNA, 32 nt, Human
uguuaccugugagugugucucucccuauuaga

SEQ ID NO: 530490 - RNA, 32 nt, Human
uguuaccuuucuuuaccagcaugguaagcaac

SEQ ID NO: 530491 - RNA, 32 nt, Human
uguuacgcacacacacgugcacacaaggcucu

SEQ ID NO: 530492 - RNA, 32 nt, Human
uguuacgcuuucugcugucccuugccaaaaau

SEQ ID NO: 530493 - RNA, 32 nt, Human
uguuacggugcaugccuguaaucccagcuacu

SEQ ID NO: 530494 - RNA, 23 nt, Human
uguuacguacuguuucuuugaua

SEQ ID NO: 530495 - RNA, 32 nt, Human
uguuacuaguacuaagagaagcaccagaagag

SEQ ID NO: 530496 - RNA, 32 nt, Human
uguuacucaaagaaucacacuaaggauagcaa

SEQ ID NO: 530497 - RNA, 32 nt, Human
uguuacucauccugcuaucaauuucuuauuaa

SEQ ID NO: 530498 - RNA, 32 nt, Human
uguuacucaucuuuauugucuccaugauuuau

SEQ ID NO: 530499 - RNA, 32 nt, Human
uguuacucugauaaucccauaaaacaaaguuu

SEQ ID NO: 530500 - RNA, 32 nt, Human
uguuacucuuucucucuccaucagcuuccuca

SEQ ID NO: 530501 - RNA, 32 nt, Human
uguuacugaagaaugaacagaugaguaagugg

SEQ ID NO: 530502 - RNA, 32 nt, Human
uguuacugagacaaaacaguacucacugagug

SEQ ID NO: 530503 - RNA, 32 nt, Human
uguuacugcccagucauaaaucugcuuuucca

SEQ ID NO: 530504 - RNA, 32 nt, Human
uguuacuggagaguucuugaagccagggauac

SEQ ID NO: 530505 - RNA, 32 nt, Human
uguuacuggccuggaaacugaagggaguuuug

SEQ ID NO: 530506 - RNA, 32 nt, Human
uguuacugggcccugagucugggcagcugucc

SEQ ID NO: 530507 - RNA, 32 nt, Human
uguuacuguauaccugcuuucccacaacagca

SEQ ID NO: 530508 - RNA, 32 nt, Human
uguuacuguccagucucuacacaugcuguccu

SEQ ID NO: 530509 - RNA, 32 nt, Human
uguuacugugcaucucugggcauggccugugu

SEQ ID NO: 530510 - RNA, 32 nt, Human
uguuacuucccucacuucaccuccauaagaac

SEQ ID NO: 530511 - RNA, 32 nt, Human
uguuacuugcuacccugaguacuuucaggaag

SEQ ID NO: 530512 - RNA, 32 nt, Human
uguuacuuggauagcuuauaugaauuuugaga

SEQ ID NO: 530513 - RNA, 32 nt, Human
uguuacuuuugggacauccugucaucugagaa

SEQ ID NO: 530514 - RNA, 32 nt, Human
uguuagaacuccagaaaauaaaggacaaagac

SEQ ID NO: 530515 - RNA, 32 nt, Human
uguuagaauaaauucaugaaauucgauuccaa

SEQ ID NO: 530516 - RNA, 32 nt, Human
uguuagaaucugauuucaccucucagcaucca

SEQ ID NO: 530517 - RNA, 32 nt, Human
uguuagacagccacaguccugucuggguuagg

SEQ ID NO: 530518 - RNA, 21 nt, Human
uguuagagcaaacaaaugcau

SEQ ID NO: 530519 - RNA, 32 nt, Human
uguuagauacuauccuuuucaaugaugagcaa

SEQ ID NO: 530520 - RNA, 22 nt, Human
uguuagauauuaggucccauca

SEQ ID NO: 530521 - RNA, 32 nt, Human
uguuagauccuuguaagcaucgcuacccgagu

SEQ ID NO: 530522 - RNA, 32 nt, Human
uguuagaucugcagaaggggacacccuggaag

SEQ ID NO: 530523 - RNA, 32 nt, Human
uguuagauguuuauagcccagcaucuugggac

SEQ ID NO: 530524 - RNA, 32 nt, Human
uguuagcaagacugggaaggaggccacauucc

SEQ ID NO: 530525 - RNA, 18 nt, Human
uguuagcaaguguguggu

SEQ ID NO: 530526 - RNA, 32 nt, Human
uguuagcaaucagcugacuccugacucaacug

SEQ ID NO: 530527 - RNA, 32 nt, Human
uguuagcagaagcauguugaugugaauuauga

SEQ ID NO: 530528 - RNA, 32 nt, Human
uguuagcagagagaaaaauaacagugaaugug

SEQ ID NO: 530529 - RNA, 32 nt, Human
uguuagcagcuuugagaaaugcugcuauagga

SEQ ID NO: 530530 - RNA, 29 nt, Human
uguuagcauuugugugugucugugggugu

SEQ ID NO: 530531 - RNA, 32 nt, Human
uguuagcauuuuauggcauugucuccuggcug

SEQ ID NO: 530532 - RNA, 32 nt, Human
uguuagccacuacaccuggccuggauugugua

SEQ ID NO: 530533 - RNA, 32 nt, Human
uguuagccacucuuggaaaaagcacaaccuaa

SEQ ID NO: 530534 - RNA, 32 nt, Human
uguuagccagcagcuccagaaaaaucccgauu

SEQ ID NO: 530535 - RNA, 32 nt, Human
uguuagccauuucguauguauguaauaugcac

SEQ ID NO: 530536 - RNA, 32 nt, Human
uguuagccccuaacucuacugccuuccacaua

SEQ ID NO: 530537 - RNA, 22 nt, Human
uguuagcccucagagucccauu

SEQ ID NO: 530538 - RNA, 32 nt, Human
uguuagcccuuaucuucuguguguaaaaucca

SEQ ID NO: 530539 - RNA, 32 nt, Human
uguuagccucugcuuucccuuccuguccugag

SEQ ID NO: 530540 - RNA, 32 nt, Human
uguuagccuuucugcaccccuuagcuuggccc

SEQ ID NO: 530541 - RNA, 32 nt, Human
uguuagccuuuucuccccagacuuguuggcau

SEQ ID NO: 530542 - RNA, 31 nt, Human
uguuagcucacuagcuuuacauaccuuaucu

SEQ ID NO: 530543 - RNA, 32 nt, Human
uguuagcugcucacuuaaacaauguccucuuu

SEQ ID NO: 530544 - RNA, 32 nt, Human
uguuagcuggagaguugaggcaggcagcaaag

SEQ ID NO: 530545 - RNA, 32 nt, Human
uguuagcuguucugccuucugggugagcuggc

SEQ ID NO: 530546 - RNA, 32 nt, Human
uguuagcuuuauuaugcuaacagucuacuuug

SEQ ID NO: 530547 - RNA, 32 nt, Human
uguuaggaaccagcugcacagcaggagaguua

SEQ ID NO: 530548 - RNA, 32 nt, Human
uguuaggaaggaucuggaauaaucuugaaggg

SEQ ID NO: 530549 - RNA, 32 nt, Human
uguuaggauaaauaaauacuggauaaccucgu

SEQ ID NO: 530550 - RNA, 32 nt, Human
uguuaggauuacaggcaugagccacugcgccc

SEQ ID NO: 530551 - RNA, 32 nt, Human
uguuaggauuuguucuggacaaugaaggggau

SEQ ID NO: 530552 - RNA, 32 nt, Human
uguuaggcacacgugaugcacauguguacaug

SEQ ID NO: 530553 - RNA, 32 nt, Human
uguuaggcagaggcuucugaccaugucugagc

SEQ ID NO: 530554 - RNA, 20 nt, Human
uguuaggcagccaugugcuc

SEQ ID NO: 530555 - RNA, 32 nt, Human
uguuagggagagaagagggagaggcaggagcc

SEQ ID NO: 530556 - RNA, 32 nt, Human
uguuagggaggcaugauuuuggugagaucuuu

SEQ ID NO: 530557 - RNA, 24 nt, Human
uguuagggauggguagaugucaaa

SEQ ID NO: 530558 - RNA, 32 nt, Human
uguuaggggaggguugggaugggcagugggcc

SEQ ID NO: 530559 - RNA, 32 nt, Human
uguuaggggcaguggagguagaaugacuccuu

SEQ ID NO: 530560 - RNA, 32 nt, Human
uguuaggggcugggaacaagaaccccucucac

SEQ ID NO: 530561 - RNA, 32 nt, Human
uguuaggguagcaugggauuacagggcccugu

SEQ ID NO: 530562 - RNA, 32 nt, Human
uguuaggguccucccugcucccaugaggauau

SEQ ID NO: 530563 - RNA, 32 nt, Human
uguuagguagguucuguccaguucuuagggac

SEQ ID NO: 530564 - RNA, 32 nt, Human
uguuagguauuggggaagagagacugaaguca

SEQ ID NO: 530565 - RNA, 32 nt, Human
uguuagguuucuguggcuacugaauauuuguu

SEQ ID NO: 530566 - RNA, 32 nt, Human
uguuagucuuccuuuaagucauagaacuuauu

SEQ ID NO: 530567 - RNA, 32 nt, Human
uguuagugggauggcaaacacugugaacauug

SEQ ID NO: 530568 - RNA, 32 nt, Human
uguuaguggggauauuugcuguucauuuuucc

SEQ ID NO: 530569 - RNA, 32 nt, Human
uguuagugucaucucuauuagaugcuuuggag

SEQ ID NO: 530570 - RNA, 32 nt, Human
uguuaguguccuuccaaaauucauauguugaa

SEQ ID NO: 530571 - RNA, 32 nt, Human
uguuaguguucugaaguaaauacagaagaggc

SEQ ID NO: 530572 - RNA, 32 nt, Human
uguuaguucaugacagacccaggugugcuuca

SEQ ID NO: 530573 - RNA, 32 nt, Human
uguuaguucuucagauuccugucucuguaaua

SEQ ID NO: 530574 - RNA, 32 nt, Human
uguuaguugcucuuucuggcucugccucuccu

SEQ ID NO: 530575 - RNA, 32 nt, Human
uguuaguuucaucagaaacuuaaaacauagac

SEQ ID NO: 530576 - RNA, 32 nt, Human
uguuauaaaaguaaauuuaggccaggcacggu

SEQ ID NO: 530577 - RNA, 24 nt, Human
uguuauacaagguuaguccuucau

SEQ ID NO: 530578 - RNA, 32 nt, Human
uguuauacuguugacuguauaugggaacuaua

SEQ ID NO: 530579 - RNA, 32 nt, Human
uguuauauaaauuccacauuuuuaugcaacua

SEQ ID NO: 530580 - RNA, 24 nt, Human
uguuauaugaacauacaaaugcau

SEQ ID NO: 530581 - RNA, 20 nt, Human
uguuauaugaguagaaauca

SEQ ID NO: 530582 - RNA, 32 nt, Human
uguuauauugccuaggcuggaaugcagugguu

SEQ ID NO: 530583 - RNA, 32 nt, Human
uguuaucacaccacugcacuccagccugggug

SEQ ID NO: 530584 - RNA, 32 nt, Human
uguuaucagcuuucagggccaugguucacauu

SEQ ID NO: 530585 - RNA, 32 nt, Human
uguuaucagugaaacagaacuguaguaacucu

SEQ ID NO: 530586 - RNA, 32 nt, Human
uguuaucaugagggaauucugaucagggucaa

SEQ ID NO: 530587 - RNA, 32 nt, Human
uguuaucauuccuccccaacauaauaauacau

SEQ ID NO: 530588 - RNA, 24 nt, Human
uguuauccaggcuggugugcagug

SEQ ID NO: 530589 - RNA, 32 nt, Human
uguuauccaugugcauaauuuaccucaugauu

SEQ ID NO: 530590 - RNA, 32 nt, Human
uguuaucccacugcacucugcuuaaggguucc

SEQ ID NO: 530591 - RNA, 32 nt, Human
uguuauccuauuuagauggccaugaagaggau

SEQ ID NO: 530592 - RNA, 32 nt, Human
uguuauccuguauaccuccuccagccaugaag

SEQ ID NO: 530593 - RNA, 32 nt, Human
uguuauccuuuguauuuauaggcacaguuauc

SEQ ID NO: 530594 - RNA, 32 nt, Human
uguuaucgaauugggagaauggggaaaguugu

SEQ ID NO: 530595 - RNA, 32 nt, Human
uguuaucuugguguguuaagaguuagguuuaa

SEQ ID NO: 530596 - RNA, 32 nt, Human
uguuaugaaagugcuuauaggcauuuuguuua

SEQ ID NO: 530597 - RNA, 32 nt, Human
uguuaugacuuuccuuuguaucuuuccuuuua

SEQ ID NO: 530598 - RNA, 32 nt, Human
uguuaugauaggacacaguaguagcggugguc

SEQ ID NO: 530599 - RNA, 32 nt, Human
uguuaugaugauugguguggcuuuaugucuuu

SEQ ID NO: 530600 - RNA, 32 nt, Human
uguuaugauucugaacauuugacuugaaccac

SEQ ID NO: 530601 - RNA, 32 nt, Human
uguuaugcacacuaaauuaaaugugacauaaa

SEQ ID NO: 530602 - RNA, 32 nt, Human
uguuaugcagguggagagaaaacaggagagua

SEQ ID NO: 530603 - RNA, 32 nt, Human
uguuauggcuuccuugauaugcucuugacagc

SEQ ID NO: 530604 - RNA, 32 nt, Human
uguuaugggcacuggucuaggccagguaugac

SEQ ID NO: 530605 - RNA, 32 nt, Human
uguuauggugcugguaauaagccucgcagccc

SEQ ID NO: 530606 - RNA, 22 nt, Human
uguuaugugcaacacaaugcau

SEQ ID NO: 530607 - RNA, 32 nt, Human
uguuaugugguugaaagggcacuggacuuagu

SEQ ID NO: 530608 - RNA, 32 nt, Human
uguuaugugguuuauauuuuucuuucucuuuc

SEQ ID NO: 530609 - RNA, 32 nt, Human
uguuauguguuuugggggccugcacaggggca

SEQ ID NO: 530610 - RNA, 32 nt, Human
uguuauuacugaggaaagggaggagaggacaa

SEQ ID NO: 530611 - RNA, 32 nt, Human
uguuauuaguaauaccucuaguaguugauacu

SEQ ID NO: 530612 - RNA, 32 nt, Human
uguuauuaugccacucgcuuuaaccuauccca

SEQ ID NO: 530613 - RNA, 32 nt, Human
uguuauuccaauaguaaggagcagggaaauau

SEQ ID NO: 530614 - RNA, 32 nt, Human
uguuauuccagugcccuguaacaaucacuggu

SEQ ID NO: 530615 - RNA, 32 nt, Human
uguuauucugccuaccacaccuuccugccacu

SEQ ID NO: 530616 - RNA, 32 nt, Human
uguuauucugucuccucuucuuugucaucagc

SEQ ID NO: 530617 - RNA, 32 nt, Human
uguuauucugugacuugcuggagguuggcagu

SEQ ID NO: 530618 - RNA, 32 nt, Human
uguuauucuugcccucucuuuugaggcucucu

SEQ ID NO: 530619 - RNA, 32 nt, Human
uguuauugagguugagggagaagagaucgguc

SEQ ID NO: 530620 - RNA, 32 nt, Human
uguuauugcgggcaccuguaaucccagcuacu

SEQ ID NO: 530621 - RNA, 32 nt, Human
uguuauugcuacugcugcugccgccgccucug

SEQ ID NO: 530622 - RNA, 32 nt, Human
uguuauuggauuuccuggaagaugugguagcu

SEQ ID NO: 530623 - RNA, 32 nt, Human
uguuauuguuaugccaccauaccauuuuguua

SEQ ID NO: 530624 - RNA, 32 nt, Human
uguuauuuauucauccaugcacccagcugucc

SEQ ID NO: 530625 - RNA, 32 nt, Human
uguuauuugaaagcuuaaaggcauuuucucau

SEQ ID NO: 530626 - RNA, 32 nt, Human
uguuauuuuaaacagaagguuguauuauuaug

SEQ ID NO: 530627 - RNA, 31 nt, Human
uguuauuuuaauaaauaucucaugaaugagu

SEQ ID NO: 530628 - RNA, 32 nt, Human
uguuauuuucaaguagcugggauuuuaaacua

SEQ ID NO: 530629 - RNA, 32 nt, Human
uguuauuuucaggcuacaugcaacaguggauu

SEQ ID NO: 530630 - RNA, 32 nt, Human
uguuauuuuccaggaaccuucuccuggugucu

SEQ ID NO: 530631 - RNA, 32 nt, Human
uguuauuuuccugggauucaugauauuugaua

SEQ ID NO: 530632 - RNA, 32 nt, Human
uguuauuuuuccaucacuaaaggccaaucaga

SEQ ID NO: 530633 - RNA, 32 nt, Human
uguucaaacugagguggaaugcagugguuccc

SEQ ID NO: 530634 - RNA, 32 nt, Human
uguucaaagguuaggcacaccauugcuguuac

SEQ ID NO: 530635 - RNA, 32 nt, Human
uguucaaauguucacaaccacaaugcaucuga

SEQ ID NO: 530636 - RNA, 32 nt, Human
uguucaaauguuccuuuuaacggaugguugaa

SEQ ID NO: 530637 - RNA, 32 nt, Human
uguucaaauguucuuuuaauggucaguuuaau

SEQ ID NO: 530638 - RNA, 32 nt, Human
uguucaaauuuuucuccaucauugauuggcuu

SEQ ID NO: 530639 - RNA, 32 nt, Human
uguucaacagcggcaaacagugcagugaauau

SEQ ID NO: 530640 - RNA, 32 nt, Human
uguucaacauggcgaaaccccauucuaccaaa

SEQ ID NO: 530641 - RNA, 32 nt, Human
uguucaaccuguuuugaccucccaggcaucug

SEQ ID NO: 530642 - RNA, 32 nt, Human
uguucaaccuuguggccaucaucagcaaccug

SEQ ID NO: 530643 - RNA, 32 nt, Human
uguucaacuauccugaacuuuuguagaaguuc

SEQ ID NO: 530644 - RNA, 32 nt, Human
uguucaacuuccucucuguucaagccagccuu

SEQ ID NO: 530645 - RNA, 20 nt, Human
uguucaagacugcucuccau

SEQ ID NO: 530646 - RNA, 32 nt, Human
uguucaagacuguucaagacuggugauuugga

SEQ ID NO: 530647 - RNA, 32 nt, Human
uguucaagagcaauuucugcccuuuguaaauu

SEQ ID NO: 530648 - RNA, 32 nt, Human
uguucaaggaagaguggcucuuagcagaggca

SEQ ID NO: 530649 - RNA, 32 nt, Human
uguucaagguaaggagacaggaggaguaggag

SEQ ID NO: 530650 - RNA, 32 nt, Human
uguucaauaaauacacauuuggcaaagaugag

SEQ ID NO: 530651 - RNA, 32 nt, Human
uguucaauaaugacggacgcauugguugagau

SEQ ID NO: 530652 - RNA, 32 nt, Human
uguucaaucucucaccacaacuggaaguguug

SEQ ID NO: 530653 - RNA, 32 nt, Human
uguucaaucuuuuggcuucccugggccacauu

SEQ ID NO: 530654 - RNA, 32 nt, Human
uguucaaugcagagaauggaaaguacgcaucc

SEQ ID NO: 530655 - RNA, 32 nt, Human
uguucacacagaaaccuguacacaaacguuca

SEQ ID NO: 530656 - RNA, 32 nt, Human
uguucacacaugcacacucacgcucacacaug

SEQ ID NO: 530657 - RNA, 32 nt, Human
uguucacaccacugcacuccagucugggcaac

SEQ ID NO: 530658 - RNA, 32 nt, Human
uguucacaccgcugcacucaagcuugggugac

SEQ ID NO: 530659 - RNA, 32 nt, Human
uguucacacgcaaggcuggcucugccuuccca

SEQ ID NO: 530660 - RNA, 32 nt, Human
uguucacacuccauggaaaccccagacuggga

SEQ ID NO: 530661 - RNA, 32 nt, Human
uguucacagcauauuauuucugugacuggauu

SEQ ID NO: 530662 - RNA, 32 nt, Human
uguucacagcuggcugugggggccuuugagga

SEQ ID NO: 530663 - RNA, 32 nt, Human
uguucacauaugcacauacacauacucauaac

SEQ ID NO: 530664 - RNA, 32 nt, Human
uguucacauccuuugcccaugugucuaugagg

SEQ ID NO: 530665 - RNA, 32 nt, Human
uguucacaucuucgcucuggccagcccauucu

SEQ ID NO: 530666 - RNA, 32 nt, Human
uguucacccacuggcuucccccuucccacuga

SEQ ID NO: 530667 - RNA, 32 nt, Human
uguucacccuccugccaggaaaaucccagaaa

SEQ ID NO: 530668 - RNA, 32 nt, Human
uguucaccuuauugaagcucacucugauguua

SEQ ID NO: 530669 - RNA, 32 nt, Human
uguucacgggccugagcuucgaggccaggcuc

SEQ ID NO: 530670 - RNA, 32 nt, Human
uguucacuccacccucagaacucugccauguu

SEQ ID NO: 530671 - RNA, 32 nt, Human
uguucacucgcaucuucaccccaaacuucccu

SEQ ID NO: 530672 - RNA, 32 nt, Human
uguucacugaagacacuugagaaagaauccuc

SEQ ID NO: 530673 - RNA, 32 nt, Human
uguucacugcaaccucugccuuccaagaucaa

SEQ ID NO: 530674 - RNA, 32 nt, Human
uguucacugccaaacuccuucucauuuaaugc

SEQ ID NO: 530675 - RNA, 32 nt, Human
uguucacugguauuuggugcauuugcuuguaa

SEQ ID NO: 530676 - RNA, 32 nt, Human
uguucacugucuccucccagguucaacagaca

SEQ ID NO: 530677 - RNA, 32 nt, Human
uguucacuuccaggaacggucucgugggcugc

SEQ ID NO: 530678 - RNA, 32 nt, Human
uguucacuuguggagacuaggcugcaaugugc

SEQ ID NO: 530679 - RNA, 32 nt, Human
uguucacuuugcucaauuuuuccucuucacug

SEQ ID NO: 530680 - RNA, 32 nt, Human
uguucagaagcacaauacuaucuccugaaaga

SEQ ID NO: 530681 - RNA, 32 nt, Human
uguucagaauacuuaauaucuccucucuucau

SEQ ID NO: 530682 - RNA, 32 nt, Human
uguucagacagccacaugaggggacagugcag

SEQ ID NO: 530683 - RNA, 32 nt, Human
uguucagaccucuuggcccaaccugcucaccc

SEQ ID NO: 530684 - RNA, 32 nt, Human
uguucagacuccugguuucuuccaggcuuaca

SEQ ID NO: 530685 - RNA, 21 nt, Human
uguucagacuggagugcagug

SEQ ID NO: 530686 - RNA, 32 nt, Human
uguucagagaaggagaaggaaaagggcuugac

SEQ ID NO: 530687 - RNA, 32 nt, Human
uguucagagcaccagaugaagacuucauuggg

SEQ ID NO: 530688 - RNA, 32 nt, Human
uguucagagcaucagaugaagacuucauuggg

SEQ ID NO: 530689 - RNA, 32 nt, Human
uguucagagcuccuaaaacccuuguaauuucc

SEQ ID NO: 530690 - RNA, 32 nt, Human
uguucagaggcagagggugcaaaggagaaaug

SEQ ID NO: 530691 - RNA, 32 nt, Human
uguucagagggagccaggaaucuacaugggua

SEQ ID NO: 530692 - RNA, 32 nt, Human
uguucagauaaaugaagcugacuuauuuaagc

SEQ ID NO: 530693 - RNA, 32 nt, Human
uguucagaucccuaugggggcccagcuggcuc

SEQ ID NO: 530694 - RNA, 21 nt, Human
uguucagcaccucccauccca

SEQ ID NO: 530695 - RNA, 32 nt, Human
uguucagcagaacaccaccacugugacauggg

SEQ ID NO: 530696 - RNA, 32 nt, Human
uguucagcagcugaacauuccuggugagcaaa

SEQ ID NO: 530697 - RNA, 32 nt, Human
uguucagcagggcugaaagcuuuuauucuuua

SEQ ID NO: 530698 - RNA, 32 nt, Human
uguucagcauggcugaaauccacacuccguau

SEQ ID NO: 530699 - RNA, 32 nt, Human
uguucagccaucagaagagagacaaggaauua

SEQ ID NO: 530700 - RNA, 17 nt, Human
uguucagcuacuucaca

SEQ ID NO: 530701 - RNA, 32 nt, Human
uguucagcucaggcacaggggcacagcagagg

SEQ ID NO: 530702 - RNA, 32 nt, Human
uguucaggaaggccaaauuagagccuucucca

SEQ ID NO: 530703 - RNA, 32 nt, Human
uguucaggaucuuuauccgcagucuccacucc

SEQ ID NO: 530704 - RNA, 32 nt, Human
uguucaggauguugaagugcagugucagaaau

SEQ ID NO: 530705 - RNA, 32 nt, Human
uguucaggcugaggcaggagaauugcuugaac

SEQ ID NO: 530706 - RNA, 32 nt, Human
uguucagggagguguggacuggaugaggaaac

SEQ ID NO: 530707 - RNA, 32 nt, Human
uguucagggaucagcacuacugugcuucuugg

SEQ ID NO: 530708 - RNA, 31 nt, Human
uguucagggcacuucuuguccucucuguccc

SEQ ID NO: 530709 - RNA, 32 nt, Human
uguucagggccuugugugggggcaguacagga

SEQ ID NO: 530710 - RNA, 32 nt, Human
uguucagguucuggcaggggcccagggaucca

SEQ ID NO: 530711 - RNA, 32 nt, Human
uguucagucauuuuuguuucuaccucccagau

SEQ ID NO: 530712 - RNA, 32 nt, Human
uguucagucuccaucauggcaugccauacucu

SEQ ID NO: 530713 - RNA, 32 nt, Human
uguucagugaacccaagaaauguaauaaauau

SEQ ID NO: 530714 - RNA, 32 nt, Human
uguucagugagaaguaaacagagcagaaguga

SEQ ID NO: 530715 - RNA, 32 nt, Human
uguucagugucacccggaagcagaguuuaaug

SEQ ID NO: 530716 - RNA, 32 nt, Human
uguucaguucauguuguacgugauggagauuu

SEQ ID NO: 530717 - RNA, 32 nt, Human
uguucauagaagcagugugcaggugaggcaaa

SEQ ID NO: 530718 - RNA, 32 nt, Human
uguucauagccaggaaacccagcucagcaaac

SEQ ID NO: 530719 - RNA, 32 nt, Human
uguucaucccuugaccaccucuggaccacuaa

SEQ ID NO: 530720 - RNA, 32 nt, Human
uguucauccgugucccugcaaaggacaugaac

SEQ ID NO: 530721 - RNA, 32 nt, Human
uguucauccucuggugcugaagcagccaagag

SEQ ID NO: 530722 - RNA, 32 nt, Human
uguucauccugccauccccaacccuuuucuac

SEQ ID NO: 530723 - RNA, 32 nt, Human
uguucauccugccccugcuccauguccuugug

SEQ ID NO: 530724 - RNA, 32 nt, Human
uguucaucuccagcagagacaacggaggaggc

SEQ ID NO: 530725 - RNA, 32 nt, Human
uguucaucuccugagugugguacccagaaugg

SEQ ID NO: 530726 - RNA, 32 nt, Human
uguucaucugcagcuguugcaagguguucaga

SEQ ID NO: 530727 - RNA, 32 nt, Human
uguucaucuguggccauuccaucaggcaguua

SEQ ID NO: 530728 - RNA, 32 nt, Human
uguucaugaaccugggcuggagcuuggggacc

SEQ ID NO: 530729 - RNA, 32 nt, Human
uguucaugacacugcacuccagccugggugau

SEQ ID NO: 530730 - RNA, 32 nt, Human
uguucaugacacugcacuccagccuuggcaac

SEQ ID NO: 530731 - RNA, 21 nt, Human
uguucaugcaguucuaacaca

SEQ ID NO: 530732 - RNA, 32 nt, Human
uguucaugccacugcacuuccagccuggguga

SEQ ID NO: 530733 - RNA, 32 nt, Human
uguucaugcccaggaucugcugcgcucaugga

SEQ ID NO: 530734 - RNA, 32 nt, Human
uguucaugccucagugggaugaauccauuaca

SEQ ID NO: 530735 - RNA, 32 nt, Human
uguucauggaaagcaggacagacagaauugug

SEQ ID NO: 530736 - RNA, 32 nt, Human
uguucaugucacugcaagacucuuucucaguc

SEQ ID NO: 530737 - RNA, 32 nt, Human
uguucauucugaccccuuccucaaccucuuca

SEQ ID NO: 530738 - RNA, 32 nt, Human
uguucauugccucugccuugccccuaugccug

SEQ ID NO: 530739 - RNA, 32 nt, Human
uguucauugggcccuuucacaccccacaguga

SEQ ID NO: 530740 - RNA, 32 nt, Human
uguucauuucucacaaacuguacugacucgag

SEQ ID NO: 530741 - RNA, 32 nt, Human
uguucauuuugaaaagacuuuguucuuuucau

SEQ ID NO: 530742 - RNA, 32 nt, Human
uguucauuuuucacuccucccuccuaggucac

SEQ ID NO: 530743 - RNA, 23 nt, Human
uguuccaaagaaaaugcugccau

SEQ ID NO: 530744 - RNA, 32 nt, Human
uguuccaaaggaagcaacagcugagagaggcc

SEQ ID NO: 530745 - RNA, 32 nt, Human
uguuccaaagugcugauauuacaggcauaaua

SEQ ID NO: 530746 - RNA, 21 nt, Human
uguuccaagaugccaccaagg

SEQ ID NO: 530747 - RNA, 32 nt, Human
uguuccaaguagcugggauuacagacgccugc

SEQ ID NO: 530748 - RNA, 32 nt, Human
uguuccaauggaagaaagugaggacucacaga

SEQ ID NO: 530749 - RNA, 32 nt, Human
uguuccaccagaggagcggacagugaaaugua

SEQ ID NO: 530750 - RNA, 32 nt, Human
uguuccaccggcacuccuggguucugaggaca

SEQ ID NO: 530751 - RNA, 32 nt, Human
uguuccacgcugccuccuccucgaguuuuccu

SEQ ID NO: 530752 - RNA, 22 nt, Human
uguuccagaaagauuacuuuuu

SEQ ID NO: 530753 - RNA, 32 nt, Human
uguuccagagucagaaccuguacaguauauaa

SEQ ID NO: 530754 - RNA, 32 nt, Human
uguuccagauagacucucucucuuucugcccu

SEQ ID NO: 530755 - RNA, 32 nt, Human
uguuccagcacuguucaggcugccugucaucc

SEQ ID NO: 530756 - RNA, 20 nt, Human
uguuccagcccaucugucuc

SEQ ID NO: 530757 - RNA, 32 nt, Human
uguuccagcucccagagaagacucuaucacag

SEQ ID NO: 530758 - RNA, 32 nt, Human
uguuccagcuccgucugcccugugccuauaua

SEQ ID NO: 530759 - RNA, 22 nt, Human
uguuccagcucuugauguuuuu

SEQ ID NO: 530760 - RNA, 32 nt, Human
uguuccaggcacuguccuaggcauuugcaucu

SEQ ID NO: 530761 - RNA, 32 nt, Human
uguuccaggcuaacagcugugggaggcuucuc

SEQ ID NO: 530762 - RNA, 23 nt, Human
uguuccaggcuaacauacuuuuu

SEQ ID NO: 530763 - RNA, 32 nt, Human
uguuccagggagcucacggucuucucagguuc

SEQ ID NO: 530764 - RNA, 32 nt, Human
uguuccagugauguaaggauauuaaguuauua

SEQ ID NO: 530765 - RNA, 32 nt, Human
uguuccaguucuggucaagggccuugggggcu

SEQ ID NO: 530766 - RNA, 32 nt, Human
uguuccaguuuugacagcugccagucuuccug

SEQ ID NO: 530767 - RNA, 32 nt, Human
uguuccaucucuucucuuucuccccucuucgc

SEQ ID NO: 530768 - RNA, 32 nt, Human
uguuccaucuggccgugucagugcaaauugca

SEQ ID NO: 530769 - RNA, 32 nt, Human
uguuccaugcagucacucagggacccagucuc

SEQ ID NO: 530770 - RNA, 31 nt, Human
uguuccauuccucaacagguuggaugaugag

SEQ ID NO: 530771 - RNA, 32 nt, Human
uguuccauuuaucucuauccuccccuuaacaa

SEQ ID NO: 530772 - RNA, 32 nt, Human
uguuccauuuucuccacaaccuugccagcauc

SEQ ID NO: 530773 - RNA, 32 nt, Human
uguucccaaacaggacguacacccgagccaug

SEQ ID NO: 530774 - RNA, 32 nt, Human
uguucccaacuccaaggggaccuggugacaga

SEQ ID NO: 530775 - RNA, 32 nt, Human
uguucccaagccggggcucuuguucacaccac

SEQ ID NO: 530776 - RNA, 32 nt, Human
uguucccaccugcuggagugaaggggccaagg

SEQ ID NO: 530777 - RNA, 32 nt, Human
uguucccacucccaucuuucuuccggacaaug

SEQ ID NO: 530778 - RNA, 32 nt, Human
uguucccagcacucaagccuugccaccgccga

SEQ ID NO: 530779 - RNA, 21 nt, Human
uguucccagcagcgaaggccu

SEQ ID NO: 530780 - RNA, 32 nt, Human
uguucccagccccugcagauucugagcaaagg

SEQ ID NO: 530781 - RNA, 32 nt, Human
uguucccagcuauucaggaggcugagguggga

SEQ ID NO: 530782 - RNA, 32 nt, Human
uguucccaggaucuugagcuuuagugugcuau

SEQ ID NO: 530783 - RNA, 32 nt, Human
uguucccaggguggaagaaguaggggacagcu

SEQ ID NO: 530784 - RNA, 32 nt, Human
uguucccaguuacuugggaggcugagguggga

SEQ ID NO: 530785 - RNA, 32 nt, Human
uguucccaucuacugucugucaucuacaacag

SEQ ID NO: 530786 - RNA, 32 nt, Human
uguucccaucugaggacucagguaauggacuu

SEQ ID NO: 530787 - RNA, 32 nt, Human
uguucccaugccaccucugggguuucuguuau

SEQ ID NO: 530788 - RNA, 32 nt, Human
uguuccccaaccacggcccagcccugccacac

SEQ ID NO: 530789 - RNA, 28 nt, Human
uguuccccaaguguacuuaaucaccuua

SEQ ID NO: 530790 - RNA, 32 nt, Human
uguuccccaaguguacuuaaucaccuuagugc

SEQ ID NO: 530791 - RNA, 32 nt, Human
uguuccccaaguguccuggaaauuugccuggu

SEQ ID NO: 530792 - RNA, 32 nt, Human
uguuccccacacaccugaaggugguagaaucu

SEQ ID NO: 530793 - RNA, 32 nt, Human
uguuccccacagccuugacuucagagaggcuu

SEQ ID NO: 530794 - RNA, 32 nt, Human
uguuccccacucccuugccccaaaaggaucug

SEQ ID NO: 530795 - RNA, 24 nt, Human
uguuccccaggccggagugcagug

SEQ ID NO: 530796 - RNA, 24 nt, Human
uguuccccaggcuggagugcaaug

SEQ ID NO: 530797 - RNA, 32 nt, Human
uguuccccauggaugaagacucugcuguuuac

SEQ ID NO: 530798 - RNA, 32 nt, Human
uguucccccaaagcuuaucugucucugagccu

SEQ ID NO: 530799 - RNA, 32 nt, Human
uguucccccuccaucucgauucucguacccaa

SEQ ID NO: 530800 - RNA, 32 nt, Human
uguucccccuggaaugugcagugggccagcug

SEQ ID NO: 530801 - RNA, 32 nt, Human
uguuccccguccaagagcaaagcuacagucgg

SEQ ID NO: 530802 - RNA, 32 nt, Human
uguuccccgugaaaagcaacauggacauuucc

SEQ ID NO: 530803 - RNA, 22 nt, Human
uguuccccucacuggaugaaau

SEQ ID NO: 530804 - RNA, 32 nt, Human
uguuccccuccaggaugcugccggacuggaag

SEQ ID NO: 530805 - RNA, 32 nt, Human
uguuccccuccauguccauguguucucauugu

SEQ ID NO: 530806 - RNA, 32 nt, Human
uguuccccugccuuugugaugaugguuugguu

SEQ ID NO: 530807 - RNA, 32 nt, Human
uguucccgggcguguguggcucuggguccagc

SEQ ID NO: 530808 - RNA, 32 nt, Human
uguucccuagaaccucccugucuuccaacugc

SEQ ID NO: 530809 - RNA, 32 nt, Human
uguucccucaucaucccccuaccugaaccccu

SEQ ID NO: 530810 - RNA, 32 nt, Human
uguucccucccaacaguucuuccucuuucucu

SEQ ID NO: 530811 - RNA, 32 nt, Human
uguucccucccaccccagggcucuccaugcuu

SEQ ID NO: 530812 - RNA, 32 nt, Human
uguucccucccaggcccuccugggugagcccg

SEQ ID NO: 530813 - RNA, 21 nt, Human
uguucccucgccucugucucc

SEQ ID NO: 530814 - RNA, 32 nt, Human
uguucccucguuugcaaaaugaggaugauacu

SEQ ID NO: 530815 - RNA, 32 nt, Human
uguucccucuccaaucuuccagccuuugggag

SEQ ID NO: 530816 - RNA, 32 nt, Human
uguucccucucccucucccuguuggcuggugg

SEQ ID NO: 530817 - RNA, 32 nt, Human
uguucccucugccuagaacacucucucccaag

SEQ ID NO: 530818 - RNA, 32 nt, Human
uguucccucuucuccccuccacuguguuuaau

SEQ ID NO: 530819 - RNA, 32 nt, Human
uguucccugcagucugugcugugugucugggc

SEQ ID NO: 530820 - RNA, 32 nt, Human
uguucccugccucggcacagccguagccuccc

SEQ ID NO: 530821 - RNA, 32 nt, Human
uguucccuggaggcagguaucacaaagcauuu

SEQ ID NO: 530822 - RNA, 32 nt, Human
uguucccuggguuccugagagaggacauugag

SEQ ID NO: 530823 - RNA, 32 nt, Human
uguucccuuaccccuguaccugugaaggauug

SEQ ID NO: 530824 - RNA, 32 nt, Human
uguucccuuagguuuuuccccaccucaauuua

SEQ ID NO: 530825 - RNA, 32 nt, Human
uguucccuuccaccccuccaguuagucccuau

SEQ ID NO: 530826 - RNA, 32 nt, Human
uguucccuuccucugugccacgcuccucuguu

SEQ ID NO: 530827 - RNA, 32 nt, Human
uguucccuugcagccaaaccagcugaugaaga

SEQ ID NO: 530828 - RNA, 32 nt, Human
uguucccuuguggcuugggacauggcacaggc

SEQ ID NO: 530829 - RNA, 32 nt, Human
uguuccgcaauguggcugaggaagggagccaa

SEQ ID NO: 530830 - RNA, 32 nt, Human
uguuccgcuccuccuccagcuggcgcagcuuc

SEQ ID NO: 530831 - RNA, 32 nt, Human
uguuccggaacuccaguucugaggggucuuga

SEQ ID NO: 530832 - RNA, 32 nt, Human
uguuccggaaucuuaguugagggacaaacauu

SEQ ID NO: 530833 - RNA, 32 nt, Human
uguuccggcucuuccccagccucagcaucacc

SEQ ID NO: 530834 - RNA, 32 nt, Human
uguuccgggcaggcauuucaggaagaccgccu

SEQ ID NO: 530835 - RNA, 32 nt, Human
uguuccgggggcagccagugcccagccccacc

SEQ ID NO: 530836 - RNA, 32 nt, Human
uguuccguuugucaucugucauggucuccuuc

SEQ ID NO: 530837 - RNA, 32 nt, Human
uguuccuacuccacccuccccuggugauaagc

SEQ ID NO: 530838 - RNA, 32 nt, Human
uguuccuacuggcuggucccagccgacaguuc

SEQ ID NO: 530839 - RNA, 32 nt, Human
uguuccuacuguggcccagcugcccagcaugg

SEQ ID NO: 530840 - RNA, 32 nt, Human
uguuccuaguugcaacaguucuuggaaaccca

SEQ ID NO: 530841 - RNA, 32 nt, Human
uguuccuauagucccagcacuuugggaggcug

SEQ ID NO: 530842 - RNA, 32 nt, Human
uguuccuaucagcagguggccccugggcauca

SEQ ID NO: 530843 - RNA, 32 nt, Human
uguuccuauuauccuccagccucuggguaugc

SEQ ID NO: 530844 - RNA, 32 nt, Human
uguuccuauuguucuuucuaugugccagguac

SEQ ID NO: 530845 - RNA, 32 nt, Human
uguuccucaccuuaucuucaggcaagaaacca

SEQ ID NO: 530846 - RNA, 32 nt, Human
uguuccucacgccagcggucagcugcggguug

SEQ ID NO: 530847 - RNA, 32 nt, Human
uguuccucauagauggcaccaucuuguguccu

SEQ ID NO: 530848 - RNA, 32 nt, Human
uguuccuccaaagcauucuccccagcaugucu

SEQ ID NO: 530849 - RNA, 32 nt, Human
uguuccuccacacauguaaaggcacaguggcu

SEQ ID NO: 530850 - RNA, 32 nt, Human
uguuccuccaccucuugcuccaaucagagguc

SEQ ID NO: 530851 - RNA, 32 nt, Human
uguuccucccaaagugcugggauuaauggcgu

SEQ ID NO: 530852 - RNA, 32 nt, Human
uguuccucccugauguucagaaugaccuaugc

SEQ ID NO: 530853 - RNA, 32 nt, Human
uguuccuccggcugccuccauggaggcagugc

SEQ ID NO: 530854 - RNA, 32 nt, Human
uguuccuccucauccucuucugagacuguugu

SEQ ID NO: 530855 - RNA, 32 nt, Human
uguuccuccuccccucuccuaucagcccuaau

SEQ ID NO: 530856 - RNA, 32 nt, Human
uguuccuccucuuccuucgcuucagccucuuc

SEQ ID NO: 530857 - RNA, 32 nt, Human
uguuccuccugccucauccuccugaguagcug

SEQ ID NO: 530858 - RNA, 32 nt, Human
uguuccucggcauugcgggccuggugggcaga

SEQ ID NO: 530859 - RNA, 32 nt, Human
uguuccucgucgggcaaaagauaaggauccga

SEQ ID NO: 530860 - RNA, 32 nt, Human
uguuccucuccaccaguguaucccaaguaguc

SEQ ID NO: 530861 - RNA, 32 nt, Human
uguuccucucuacaagaaccugggaggccaac

SEQ ID NO: 530862 - RNA, 32 nt, Human
uguuccucucuagccugugcucuccauaugcu

SEQ ID NO: 530863 - RNA, 32 nt, Human
uguuccucucugcuuuguucuucccuggacug

SEQ ID NO: 530864 - RNA, 32 nt, Human
uguuccucuggggcagcccccaccuccguccu

SEQ ID NO: 530865 - RNA, 32 nt, Human
uguuccucuguccugguaacauucuccuucua

SEQ ID NO: 530866 - RNA, 32 nt, Human
uguuccucuuucuccccgacuccaccccagcu

SEQ ID NO: 530867 - RNA, 32 nt, Human
uguuccucuuuggucccaagagcagcagccgc

SEQ ID NO: 530868 - RNA, 29 nt, Human
uguuccugaaugcacucauccccucaaag

SEQ ID NO: 530869 - RNA, 22 nt, Human
uguuccugaggcagcacuuuua

SEQ ID NO: 530870 - RNA, 32 nt, Human
uguuccugagggaggccgguguggaaagccuu

SEQ ID NO: 530871 - RNA, 32 nt, Human
uguuccugcaccugccgguuauuuccaagaag

SEQ ID NO: 530872 - RNA, 32 nt, Human
uguuccugcacuccacccugcuggccccagga

SEQ ID NO: 530873 - RNA, 32 nt, Human
uguuccugccucuccgccaccuccaccgcggc

SEQ ID NO: 530874 - RNA, 32 nt, Human
uguuccugcuaccuuccugaccccugugcuca

SEQ ID NO: 530875 - RNA, 32 nt, Human
uguuccugcucacucuuugccuucuccuucuc

SEQ ID NO: 530876 - RNA, 32 nt, Human
uguuccugcucacuucaagcuucuuccaugga

SEQ ID NO: 530877 - RNA, 32 nt, Human
uguuccugcucgguuucuggauugcuugguac

SEQ ID NO: 530878 - RNA, 32 nt, Human
uguuccuggcaaccugucuucuguuaccucag

SEQ ID NO: 530879 - RNA, 32 nt, Human
uguuccuggccugcugguucagugggcuggcu

SEQ ID NO: 530880 - RNA, 23 nt, Human
uguuccuggcugcuguguuucca

SEQ ID NO: 530881 - RNA, 32 nt, Human
uguuccugggaucgggcugaggccaggccucu

SEQ ID NO: 530882 - RNA, 22 nt, Human
uguuccuggugaagcaguuuca

SEQ ID NO: 530883 - RNA, 23 nt, Human
uguuccugguuuaaagccuuuca

SEQ ID NO: 530884 - RNA, 32 nt, Human
uguuccuguagucccagcacucugggaaccug

SEQ ID NO: 530885 - RNA, 32 nt, Human
uguuccuguagucccagcuccccaggaggcug

SEQ ID NO: 530886 - RNA, 32 nt, Human
uguuccuguauuguggccuggugccauuuuug

SEQ ID NO: 530887 - RNA, 32 nt, Human
uguuccugucaggauuuguuucccucugcugu

SEQ ID NO: 530888 - RNA, 32 nt, Human
uguuccuguccugucuucacugagcgcagggc

SEQ ID NO: 530889 - RNA, 32 nt, Human
uguuccugugcaaauaaugaaagagcucggua

SEQ ID NO: 530890 - RNA, 32 nt, Human
uguuccugugucugagccuggaagaggcucgg

SEQ ID NO: 530891 - RNA, 32 nt, Human
uguuccuuacaucuuccaguuggaggugaguu

SEQ ID NO: 530892 - RNA, 32 nt, Human
uguuccuuagguugcacuagucggggguucca

SEQ ID NO: 530893 - RNA, 32 nt, Human
uguuccuucuacugcuuuucaguucccuuccc

SEQ ID NO: 530894 - RNA, 32 nt, Human
uguuccuugaaaugcuaaacuuaauggcugua

SEQ ID NO: 530895 - RNA, 32 nt, Human
uguuccuugaggauuugucacagucugcccac

SEQ ID NO: 530896 - RNA, 32 nt, Human
uguuccuugcagcccccucccucucagguguc

SEQ ID NO: 530897 - RNA, 32 nt, Human
uguuccuugccugagagucacugaaggaaauu

SEQ ID NO: 530898 - RNA, 32 nt, Human
uguuccuugguaaacugcucuuagcuaagaug

SEQ ID NO: 530899 - RNA, 32 nt, Human
uguuccuuguuuccuuuuauucuuccaucuga

SEQ ID NO: 530900 - RNA, 32 nt, Human
uguuccuuuccccucaccugcuugccuccuua

SEQ ID NO: 530901 - RNA, 32 nt, Human
uguuccuuuucccacuuucuggguggcuuuuu

SEQ ID NO: 530902 - RNA, 32 nt, Human
uguucgaggacucgcgggugugcagugcaccu

SEQ ID NO: 530903 - RNA, 32 nt, Human
uguucgaguccucugugccugcccuggcguuc

SEQ ID NO: 530904 - RNA, 32 nt, Human
uguucgcacauccugugugugcacagcugucc

SEQ ID NO: 530905 - RNA, 32 nt, Human
uguucgcaccacugcacuccagccugggugau

SEQ ID NO: 530906 - RNA, 32 nt, Human
uguucgcccagugccacgucugcaugugaagc

SEQ ID NO: 530907 - RNA, 32 nt, Human
uguucgccucaucuaaccccugccugcagggu

SEQ ID NO: 530908 - RNA, 32 nt, Human
uguucgccucucaaggagagcuuugauccuca

SEQ ID NO: 530909 - RNA, 32 nt, Human
uguucgcuccgguucuuggugaagacaggguu

SEQ ID NO: 530910 - RNA, 30 nt, Human
uguucgcuuggcuccaugcuccucacugcc

SEQ ID NO: 530911 - RNA, 32 nt, Human
uguucggaggggugaaagcauuaagaagccca

SEQ ID NO: 530912 - RNA, 32 nt, Human
uguucggcaaaaggaccuccaccaagacugaa

SEQ ID NO: 530913 - RNA, 32 nt, Human
uguucggcaccugucugugccucuggcaccag

SEQ ID NO: 530914 - RNA, 32 nt, Human
uguucgggaggcaaauuucccuaggaaaaaga

SEQ ID NO: 530915 - RNA, 32 nt, Human
uguucguauuagagacaaaaucuguguaacag

SEQ ID NO: 530916 - RNA, 32 nt, Human
uguucgucacucaaaugaauuugcuaaauaca

SEQ ID NO: 530917 - RNA, 32 nt, Human
uguucguccugagacggagucucgcucugucg

SEQ ID NO: 530918 - RNA, 32 nt, Human
uguucgugcccgaggcugcgcagcacugaggu

SEQ ID NO: 530919 - RNA, 32 nt, Human
uguucguggacgagaacacguucuccaacgac

SEQ ID NO: 530920 - RNA, 32 nt, Human
uguucguggacgagaacacguucuccagcgac

SEQ ID NO: 530921 - RNA, 32 nt, Human
uguucguguguauugucagugugugcuagcug

SEQ ID NO: 530922 - RNA, 32 nt, Human
uguucguuaauauccauguaacaaucccauug

SEQ ID NO: 530923 - RNA, 32 nt, Human
uguucguucugagacggagucucgcucugucg

SEQ ID NO: 530924 - RNA, 32 nt, Human
uguucguuucaucaggcucuguuccucaaugg

SEQ ID NO: 530925 - RNA, 32 nt, Human
uguucguuugaguggugacauccagguggcag

SEQ ID NO: 530926 - RNA, 32 nt, Human
uguucguuuugcaguguguccauacgguuccu

SEQ ID NO: 530927 - RNA, 32 nt, Human
uguucuaaaaugggauuuaacuauagaaaugu

SEQ ID NO: 530928 - RNA, 32 nt, Human
uguucuaaccaauaaacagaacuauuucuuac

SEQ ID NO: 530929 - RNA, 22 nt, Human
uguucuaagaaaugcagcgaug

SEQ ID NO: 530930 - RNA, 32 nt, Human
uguucuaagaacggaagcaucugggcuggaug

SEQ ID NO: 530931 - RNA, 32 nt, Human
uguucuaauauugggacuucugauuauguuca

SEQ ID NO: 530932 - RNA, 23 nt, Human
uguucuacaccaacgcccuggca

SEQ ID NO: 530933 - RNA, 32 nt, Human
uguucuacagucucagggagguggugggcggg

SEQ ID NO: 530934 - RNA, 32 nt, Human
uguucuaccagaaaaacgucucccaaucaccc

SEQ ID NO: 530935 - RNA, 32 nt, Human
uguucuagagcuuccuacaggcagagucaggc

SEQ ID NO: 530936 - RNA, 32 nt, Human
uguucuagggaacggaaaagaguucauggcca

SEQ ID NO: 530937 - RNA, 32 nt, Human
uguucuaggugguggcuaaaucugggccuaau

SEQ ID NO: 530938 - RNA, 32 nt, Human
uguucuagugcauuuccaugguccccaauuca

SEQ ID NO: 530939 - RNA, 32 nt, Human
uguucuauacacuaucaaauauauaaagcuuu

SEQ ID NO: 530940 - RNA, 32 nt, Human
uguucuauagcauccuccugugcucuuaccua

SEQ ID NO: 530941 - RNA, 32 nt, Human
uguucuaucuuucugucccaccugcacuggga

SEQ ID NO: 530942 - RNA, 32 nt, Human
uguucuauuuugggguacugguuuucuaucca

SEQ ID NO: 530943 - RNA, 32 nt, Human
uguucucaaaucagaagaauugcaaaagaaug

SEQ ID NO: 530944 - RNA, 32 nt, Human
uguucucacaccauuucacuuccucuuccucu

SEQ ID NO: 530945 - RNA, 32 nt, Human
uguucucacagaacagaaccccacagcuggau

SEQ ID NO: 530946 - RNA, 31 nt, Human
uguucucacagcuggcgggaagcaagcgccu

SEQ ID NO: 530947 - RNA, 20 nt, Human
uguucucacaucucuguccc

SEQ ID NO: 530948 - RNA, 22 nt, Human
uguucucaccucaugcugcucc

SEQ ID NO: 530949 - RNA, 21 nt, Human
uguucucaccucugcuguccc

SEQ ID NO: 530950 - RNA, 32 nt, Human
uguucucacucguaagugggaauugacaauga

SEQ ID NO: 530951 - RNA, 32 nt, Human
uguucucacuuaaaaguggaagcugacaauga

SEQ ID NO: 530952 - RNA, 32 nt, Human
uguucucagaguugcgcuuuugaggagugguu

SEQ ID NO: 530953 - RNA, 32 nt, Human
uguucucagccuccugaguacuuaccagaguu

SEQ ID NO: 530954 - RNA, 24 nt, Human
uguucucagcucccagcgaagccu

SEQ ID NO: 530955 - RNA, 20 nt, Human
uguucucagcucccccuguc

SEQ ID NO: 530956 - RNA, 22 nt, Human
uguucucagcucccccuguccc

SEQ ID NO: 530957 - RNA, 32 nt, Human
uguucucagcucccccuguccccucagcucca

SEQ ID NO: 530958 - RNA, 22 nt, Human
uguucucaggcugcuccuccau

SEQ ID NO: 530959 - RNA, 21 nt, Human
uguucucaguacgaaaaaccu

SEQ ID NO: 530960 - RNA, 32 nt, Human
uguucucaguaugcaaaaccugaaaucagaug

SEQ ID NO: 530961 - RNA, 31 nt, Human
uguucucaguuucaggcaacugauuucaaau

SEQ ID NO: 530962 - RNA, 32 nt, Human
uguucucaucccugguuccuuggccacggugg

SEQ ID NO: 530963 - RNA, 21 nt, Human
uguucucauucuuuucacucc

SEQ ID NO: 530964 - RNA, 23 nt, Human
uguucucauuuagauuuaucucc

SEQ ID NO: 530965 - RNA, 32 nt, Human
uguucuccagccugggcaacagagugaguccc

SEQ ID NO: 530966 - RNA, 32 nt, Human
uguucuccauaggagggaaggagcagucacug

SEQ ID NO: 530967 - RNA, 32 nt, Human
uguucucccagagcugcaccugccucgcagag

SEQ ID NO: 530968 - RNA, 32 nt, Human
uguucucccucacucugcccuuaguuaauaga

SEQ ID NO: 530969 - RNA, 32 nt, Human
uguucucccucccugccauuguggacucuugu

SEQ ID NO: 530970 - RNA, 32 nt, Human
uguucucccuuucucucuccucucugcuucau

SEQ ID NO: 530971 - RNA, 32 nt, Human
uguucuccgggaccacacagccuccaccaugu

SEQ ID NO: 530972 - RNA, 32 nt, Human
uguucuccuacagaaaagugauucugugaggg

SEQ ID NO: 530973 - RNA, 32 nt, Human
uguucuccucacugccucuuccuauuaggagg

SEQ ID NO: 530974 - RNA, 32 nt, Human
uguucuccucgagggcuccagcauccucugcu

SEQ ID NO: 530975 - RNA, 32 nt, Human
uguucuccuuucucuuucuuuugccuauuaaa

SEQ ID NO: 530976 - RNA, 32 nt, Human
uguucucggauuucaccuuaaaggaggaaggc

SEQ ID NO: 530977 - RNA, 32 nt, Human
uguucucuaacagggccagcugagcagcacag

SEQ ID NO: 530978 - RNA, 32 nt, Human
uguucucuaugcccacugcccuccucccucuc

SEQ ID NO: 530979 - RNA, 32 nt, Human
uguucucucaggacuccugggucccagggguc

SEQ ID NO: 530980 - RNA, 32 nt, Human
uguucucuccaccuucaguuuagcgucauucc

SEQ ID NO: 530981 - RNA, 32 nt, Human
uguucucuccaucucccuagucaucauuuuca

SEQ ID NO: 530982 - RNA, 32 nt, Human
uguucucucccaggggcuggcuucaggaggga

SEQ ID NO: 530983 - RNA, 32 nt, Human
uguucucucugagccuggaugggcuuggggcc

SEQ ID NO: 530984 - RNA, 32 nt, Human
uguucucugaguaugcagcagugcaguugaag

SEQ ID NO: 530985 - RNA, 32 nt, Human
uguucucugauugugaggucacugugaaugau

SEQ ID NO: 530986 - RNA, 32 nt, Human
uguucucugcauccccucaccaccuuccuuug

SEQ ID NO: 530987 - RNA, 32 nt, Human
uguucucugcucccauccuucgcucaccagcu

SEQ ID NO: 530988 - RNA, 22 nt, Human
uguucucuggcaaauucuucac

SEQ ID NO: 530989 - RNA, 32 nt, Human
uguucucuguaagcuucauccaugcugguuau

SEQ ID NO: 530990 - RNA, 32 nt, Human
uguucucuguacugggcccccuugcccuguuc

SEQ ID NO: 530991 - RNA, 32 nt, Human
uguucucugucgugagugucucuugucuaaac

SEQ ID NO: 530992 - RNA, 32 nt, Human
uguucucuguucuguuucccaaugcagaaaag

SEQ ID NO: 530993 - RNA, 32 nt, Human
uguucucuguuguaugagaaacugacaccaag

SEQ ID NO: 530994 - RNA, 32 nt, Human
uguucucuuauuucugaggcccuucagucucc

SEQ ID NO: 530995 - RNA, 32 nt, Human
uguucucuuccugcccauuuccuugaaccucc

SEQ ID NO: 530996 - RNA, 32 nt, Human
uguucucuugcccaggcuggagugcaguggca

SEQ ID NO: 530997 - RNA, 32 nt, Human
uguucucuuuggcauaaucugccuugcacucu

SEQ ID NO: 530998 - RNA, 32 nt, Human
uguucucuuuucucaguuaucucccuccucaa

SEQ ID NO: 530999 - RNA, 32 nt, Human
uguucugaaaccacuggugucugcucagaugu

SEQ ID NO: 531000 - RNA, 32 nt, Human
uguucugaaacuaacagugaggggacaaagca

SEQ ID NO: 531001 - RNA, 32 nt, Human
uguucugaacugcucccuucccuccguuccuu

SEQ ID NO: 531002 - RNA, 32 nt, Human
uguucugaaggauacucuccuccaucaccccu

SEQ ID NO: 531003 - RNA, 32 nt, Human
uguucugagaucaggaaguaacagugagaguc

SEQ ID NO: 531004 - RNA, 32 nt, Human
uguucugagaucaugcaucucccacccaucug

SEQ ID NO: 531005 - RNA, 32 nt, Human
uguucugagauggacaaauucaguguuggaaa

SEQ ID NO: 531006 - RNA, 32 nt, Human
uguucugaggagaccugcacuugagaacaaaa

SEQ ID NO: 531007 - RNA, 32 nt, Human
uguucugaggccuuuagccucugaaugauacc

SEQ ID NO: 531008 - RNA, 32 nt, Human
uguucugagucccugaggguuuacugugaagu

SEQ ID NO: 531009 - RNA, 32 nt, Human
uguucugauauuggacaguaaaauccacagac

SEQ ID NO: 531010 - RNA, 32 nt, Human
uguucugaucacuggucugugcccucacagca

SEQ ID NO: 531011 - RNA, 32 nt, Human
uguucugcaaccugugguuugggugugaggaa

SEQ ID NO: 531012 - RNA, 32 nt, Human
uguucugcaggcagccagaaaaggaggaggca

SEQ ID NO: 531013 - RNA, 32 nt, Human
uguucugcagucaucuccccuccuggcgaguu

SEQ ID NO: 531014 - RNA, 32 nt, Human
uguucugcaucccagacuccagccggcucucc

SEQ ID NO: 531015 - RNA, 16 nt, Human
uguucugccccgcaag

SEQ ID NO: 531016 - RNA, 32 nt, Human
uguucugccuguccucgcucucuccccgccua

SEQ ID NO: 531017 - RNA, 32 nt, Human
uguucugcgccaagcuccuaucaugccaauug

SEQ ID NO: 531018 - RNA, 32 nt, Human
uguucugcuacuugagaucauggggaacauau

SEQ ID NO: 531019 - RNA, 32 nt, Human
uguucugcucucacuuguccacuguggccuug

SEQ ID NO: 531020 - RNA, 32 nt, Human
uguucugcugcccagguuggagugcaguggca

SEQ ID NO: 531021 - RNA, 24 nt, Human
uguucugcuugcguuuuugaaaca

SEQ ID NO: 531022 - RNA, 21 nt, Human
uguucuggaaaacaagagggc

SEQ ID NO: 531023 - RNA, 32 nt, Human
uguucuggaaacaaaguacuguugaaaccagc

SEQ ID NO: 531024 - RNA, 32 nt, Human
uguucuggaacagggugaaacucucccagaga

SEQ ID NO: 531025 - RNA, 32 nt, Human
uguucuggaggcaccagaccuugaaaagaaca

SEQ ID NO: 531026 - RNA, 32 nt, Human
uguucuggaggcaccaugacaaagcaccagac

SEQ ID NO: 531027 - RNA, 32 nt, Human
uguucuggaguggaaagagcacgauagagcac

SEQ ID NO: 531028 - RNA, 32 nt, Human
uguucuggaguggccuguagcagacacugaac

SEQ ID NO: 531029 - RNA, 32 nt, Human
uguucuggcauuuccaguuguuccacacuccc

SEQ ID NO: 531030 - RNA, 32 nt, Human
uguucuggccagaaggaggagccaagacccac

SEQ ID NO: 531031 - RNA, 32 nt, Human
uguucuggcuagaugagagggaacccaggaau

SEQ ID NO: 531032 - RNA, 32 nt, Human
uguucuggcucuuccaggcugggagagccuuu

SEQ ID NO: 531033 - RNA, 32 nt, Human
uguucuggcuguggcccugccuuagacugucu

SEQ ID NO: 531034 - RNA, 32 nt, Human
uguucugggaaggccugggugugugcacaagg

SEQ ID NO: 531035 - RNA, 32 nt, Human
uguucugggagcacagaugauaagcucuggaa

SEQ ID NO: 531036 - RNA, 32 nt, Human
uguucugggaggaccccuaaaagggagcagcu

SEQ ID NO: 531037 - RNA, 32 nt, Human
uguucugggccucaugggggcagcgggaggug

SEQ ID NO: 531038 - RNA, 18 nt, Human
uguucuggggcaggggga

SEQ ID NO: 531039 - RNA, 32 nt, Human
uguucuggggcugggccucggugcaggucugg

SEQ ID NO: 531040 - RNA, 32 nt, Human
uguucuggguguucaggugcagcugguccucc

SEQ ID NO: 531041 - RNA, 32 nt, Human
uguucuggucaccaugccaguaguccuagguu

SEQ ID NO: 531042 - RNA, 32 nt, Human
uguucuggucccgggggcgcagcuuggagagc

SEQ ID NO: 531043 - RNA, 32 nt, Human
uguucugguggagugggaagggaggcuugggu

SEQ ID NO: 531044 - RNA, 32 nt, Human
uguucugguuacuguucuaaggcugugccauc

SEQ ID NO: 531045 - RNA, 31 nt, Human
uguucuguaaaauuagucuguugaaaauguu

SEQ ID NO: 531046 - RNA, 32 nt, Human
uguucuguaacccaggcuggagugcaguggcc

SEQ ID NO: 531047 - RNA, 32 nt, Human
uguucuguacagaguaaugagaugugugacgg

SEQ ID NO: 531048 - RNA, 21 nt, Human
uguucuguacuuuuuggcaua

SEQ ID NO: 531049 - RNA, 32 nt, Human
uguucuguaggcacuuugagaagaggaagagu

SEQ ID NO: 531050 - RNA, 32 nt, Human
uguucugucacccaggcuggagugcaguggca

SEQ ID NO: 531051 - RNA, 32 nt, Human
uguucugucacccaggcuggagugcaguggug

SEQ ID NO: 531052 - RNA, 32 nt, Human
uguucugucacccaggcuggggugcaguggcg

SEQ ID NO: 531053 - RNA, 32 nt, Human
uguucugucaccuaggcuggaaugcaguggug

SEQ ID NO: 531054 - RNA, 32 nt, Human
uguucugucaccuaggguggagugcaguggca

SEQ ID NO: 531055 - RNA, 32 nt, Human
uguucugucacucaggcuggaguacaguggug

SEQ ID NO: 531056 - RNA, 32 nt, Human
uguucugucgcccaggcuggcgugcaguggcg

SEQ ID NO: 531057 - RNA, 32 nt, Human
uguucugucucccaggcugaagugcagugagu

SEQ ID NO: 531058 - RNA, 32 nt, Human
uguucugucugaaaauuuguagaugggucuaa

SEQ ID NO: 531059 - RNA, 32 nt, Human
uguucugugaauagcaguggcaaaauauuaug

SEQ ID NO: 531060 - RNA, 25 nt, Human
uguucugugcuggacuucuaauaua

SEQ ID NO: 531061 - RNA, 32 nt, Human
uguucugugguuuuccccucccuggguucaga

SEQ ID NO: 531062 - RNA, 32 nt, Human
uguucugugucacucggcccuggguagucuac

SEQ ID NO: 531063 - RNA, 23 nt, Human
uguucugugucagcacccaggac

SEQ ID NO: 531064 - RNA, 21 nt, Human
uguucuguucaucuaaaugca

SEQ ID NO: 531065 - RNA, 32 nt, Human
uguucuguuccuccuccucaugcauuuccagc

SEQ ID NO: 531066 - RNA, 22 nt, Human
uguucuguucuaugccuaagca

SEQ ID NO: 531067 - RNA, 19 nt, Human
uguucuguucuccuaauac

SEQ ID NO: 531068 - RNA, 32 nt, Human
uguucuguugacuggggcccugcagacucugg

SEQ ID NO: 531069 - RNA, 32 nt, Human
uguucuguugaucccacuucacugugagggga

SEQ ID NO: 531070 - RNA, 32 nt, Human
uguucuguugcccaggagggagugcaguggug

SEQ ID NO: 531071 - RNA, 32 nt, Human
uguucuguugccugggcuggagugcaguggca

SEQ ID NO: 531072 - RNA, 32 nt, Human
uguucuguugccugggcuggagugcaguggcg

SEQ ID NO: 531073 - RNA, 32 nt, Human
uguucuguuggaagagucucuggcccagucau

SEQ ID NO: 531074 - RNA, 24 nt, Human
uguucuguuucaccauguaacaca

SEQ ID NO: 531075 - RNA, 32 nt, Human
uguucuguuuuugcuuuuccucuucuugacca

SEQ ID NO: 531076 - RNA, 32 nt, Human
uguucuuaaaccgacucagugugucauccccg

SEQ ID NO: 531077 - RNA, 32 nt, Human
uguucuuaagggagguuuguucuggugcauug

SEQ ID NO: 531078 - RNA, 32 nt, Human
uguucuuagauaugggccucucagccuggcag

SEQ ID NO: 531079 - RNA, 32 nt, Human
uguucuuaggauucugacuaagaggcaaaaga

SEQ ID NO: 531080 - RNA, 32 nt, Human
uguucuuaggcauucuaucuuugcucaaauug

SEQ ID NO: 531081 - RNA, 19 nt, Human
uguucuuaggggucacuga

SEQ ID NO: 531082 - RNA, 32 nt, Human
uguucuuauccaaugggaccucuccuugggaa

SEQ ID NO: 531083 - RNA, 32 nt, Human
uguucuucagcagccugucauaggaacuggau

SEQ ID NO: 531084 - RNA, 32 nt, Human
uguucuucagugcuggagguccuggcaggguc

SEQ ID NO: 531085 - RNA, 32 nt, Human
uguucuucauccccuucucccugcagggcauc

SEQ ID NO: 531086 - RNA, 32 nt, Human
uguucuucccuaauacuuucuuuacuucacaa

SEQ ID NO: 531087 - RNA, 32 nt, Human
uguucuucccucagccucgccugcugugcuga

SEQ ID NO: 531088 - RNA, 32 nt, Human
uguucuucccugaucaguccucccagacugca

SEQ ID NO: 531089 - RNA, 32 nt, Human
uguucuuccuucacaaccuucugagccuucuu

SEQ ID NO: 531090 - RNA, 32 nt, Human
uguucuuccuucuuccucagucuuccugucca

SEQ ID NO: 531091 - RNA, 32 nt, Human
uguucuucuccuucagcuucggcuucacccac

SEQ ID NO: 531092 - RNA, 32 nt, Human
uguucuucucuuaagaggcuuccagagaaaac

SEQ ID NO: 531093 - RNA, 21 nt, Human
uguucuugaacuccugacaua

SEQ ID NO: 531094 - RNA, 32 nt, Human
uguucuugcaacagucuucuucccagggaugg

SEQ ID NO: 531095 - RNA, 32 nt, Human
uguucuugccacugucccuacccuccaggagu

SEQ ID NO: 531096 - RNA, 32 nt, Human
uguucuugccuuggaccugcaggugugcagac

SEQ ID NO: 531097 - RNA, 32 nt, Human
uguucuugcuuuuuaauggaaaaagaaacgug

SEQ ID NO: 531098 - RNA, 32 nt, Human
uguucuuggccucugcuuuuaugucuauacaa

SEQ ID NO: 531099 - RNA, 32 nt, Human
uguucuuggguaaggaaauggaauacugaagg

SEQ ID NO: 531100 - RNA, 32 nt, Human
uguucuuggucuucaacuuucaucccugaugg

SEQ ID NO: 531101 - RNA, 32 nt, Human
uguucuuuaacuuauugagauguugcaagaaa

SEQ ID NO: 531102 - RNA, 32 nt, Human
uguucuuuacaaaggcuagcucaguccaacau

SEQ ID NO: 531103 - RNA, 32 nt, Human
uguucuuuaccucccuuuauuuggugcagaga

SEQ ID NO: 531104 - RNA, 32 nt, Human
uguucuuuagaacuguguucucaccuucccaa

SEQ ID NO: 531105 - RNA, 32 nt, Human
uguucuuuagcuguuggcuuucucugaggugu

SEQ ID NO: 531106 - RNA, 32 nt, Human
uguucuuuauguagaauugcugucuaugauug

SEQ ID NO: 531107 - RNA, 32 nt, Human
uguucuuucaacaauguugacagcaucuucac

SEQ ID NO: 531108 - RNA, 32 nt, Human
uguucuuucuagcaucucuccccacccucuga

SEQ ID NO: 531109 - RNA, 32 nt, Human
uguucuuucucaucgcucuccuugccagcuuu

SEQ ID NO: 531110 - RNA, 23 nt, Human
uguucuuugcagcagugcuucca

SEQ ID NO: 531111 - RNA, 32 nt, Human
uguucuuugcaggcaaagacuuguucaaugcg

SEQ ID NO: 531112 - RNA, 32 nt, Human
uguucuuuuauuucuuuuucucuuugauugaa

SEQ ID NO: 531113 - RNA, 32 nt, Human
uguucuuuuucugaacuccauuuuggauuuug

SEQ ID NO: 531114 - RNA, 32 nt, Human
uguugaaaaagugaaaccagcccgggagaauu

SEQ ID NO: 531115 - RNA, 32 nt, Human
uguugaaaacuauuguuucauuucuucuuuua

SEQ ID NO: 531116 - RNA, 32 nt, Human
uguugaaaauacuuuaaagaugccuagugaaa

SEQ ID NO: 531117 - RNA, 32 nt, Human
uguugaaacuuacacuguuucaucucagcuuu

SEQ ID NO: 531118 - RNA, 32 nt, Human
uguugaaagcuucacaagaccauuguuaagag

SEQ ID NO: 531119 - RNA, 32 nt, Human
uguugaacaaaauauucacaacagggcaguug

SEQ ID NO: 531120 - RNA, 32 nt, Human
uguugaacagcuuuucaagcauuuggggaguu

SEQ ID NO: 531121 - RNA, 32 nt, Human
uguugaaccauccuugcaucccagaaauaacu

SEQ ID NO: 531122 - RNA, 32 nt, Human
uguugaaccauccuugcaucccagaaauaagu

SEQ ID NO: 531123 - RNA, 32 nt, Human
uguugaaccauccuugcaugccagaaguaaau

SEQ ID NO: 531124 - RNA, 32 nt, Human
uguugaagaaauucacauucucuuauaguuug

SEQ ID NO: 531125 - RNA, 32 nt, Human
uguugaagaauagaguuaggcaccagaagaag

SEQ ID NO: 531126 - RNA, 32 nt, Human
uguugaagcaagaagacaaacuguauggugga

SEQ ID NO: 531127 - RNA, 32 nt, Human
uguugaagccuccuggaauguuugagucaagg

SEQ ID NO: 531128 - RNA, 32 nt, Human
uguugaagcugggcauuaccugggcaguggac

SEQ ID NO: 531129 - RNA, 32 nt, Human
uguugaaggagaggaacaagagugauagcaga

SEQ ID NO: 531130 - RNA, 32 nt, Human
uguugaaguagaaagugcccuggcagagcauc

SEQ ID NO: 531131 - RNA, 32 nt, Human
uguugaagugcacauguuuuucaagaguaaaa

SEQ ID NO: 531132 - RNA, 26 nt, Human
uguugaauccuucaacaaauguguca

SEQ ID NO: 531133 - RNA, 32 nt, Human
uguugaaucuggaugagggcauguggaguuca

SEQ ID NO: 531134 - RNA, 32 nt, Human
uguugaauggugagcacgugaccaugccgacc

SEQ ID NO: 531135 - RNA, 32 nt, Human
uguugaauugaucuucuauuuuucccucuggu

SEQ ID NO: 531136 - RNA, 32 nt, Human
uguugacaaauugagauuugcugauggaagaa

SEQ ID NO: 531137 - RNA, 32 nt, Human
uguugacagccuugcacuuccacaggcuacaa

SEQ ID NO: 531138 - RNA, 32 nt, Human
uguugacauuuucuccccuuccucacuuacag

SEQ ID NO: 531139 - RNA, 24 nt, Human
uguugaccaggcuggagugaagug

SEQ ID NO: 531140 - RNA, 24 nt, Human
uguugaccaggcuggagugcagug

SEQ ID NO: 531141 - RNA, 21 nt, Human
uguugaccaggcuggucucaa

SEQ ID NO: 531142 - RNA, 32 nt, Human
uguugacccauuucgugaccuaccuccgugac

SEQ ID NO: 531143 - RNA, 32 nt, Human
uguugaccccucucuccuagagaccuugaggc

SEQ ID NO: 531144 - RNA, 32 nt, Human
uguugaccgagccacaggccacggacaggggc

SEQ ID NO: 531145 - RNA, 32 nt, Human
uguugaccuaugcacgugacacugccuacggc

SEQ ID NO: 531146 - RNA, 32 nt, Human
uguugaccuggugcaagaaacaugcucuggug

SEQ ID NO: 531147 - RNA, 17 nt, Human
uguugaccuguaaggaa

SEQ ID NO: 531148 - RNA, 32 nt, Human
uguugaccuucucucaacuuguggagugacag

SEQ ID NO: 531149 - RNA, 32 nt, Human
uguugacggaagaaaaguaggaaugcagccuc

SEQ ID NO: 531150 - RNA, 32 nt, Human
uguugacucccaggugggccuggcugcccacu

SEQ ID NO: 531151 - RNA, 32 nt, Human
uguugacuccugcauuauaaaacaucuaagau

SEQ ID NO: 531152 - RNA, 32 nt, Human
uguugacucuauucugaauuuccucccuuggg

SEQ ID NO: 531153 - RNA, 32 nt, Human
uguugacucugccuugcucaaguucucaccac

SEQ ID NO: 531154 - RNA, 32 nt, Human
uguugacugcugggcccgauucugauaugagu

SEQ ID NO: 531155 - RNA, 32 nt, Human
uguugacuguccugaaaaacuugacauaccua

SEQ ID NO: 531156 - RNA, 32 nt, Human
uguugacuugaggaguuaaugugaucuuuggg

SEQ ID NO: 531157 - RNA, 32 nt, Human
uguugacuuugucccuggcaaaauuuuccacu

SEQ ID NO: 531158 - RNA, 19 nt, Human
uguugagaagaguuuggau

SEQ ID NO: 531159 - RNA, 32 nt, Human
uguugagaagucuguggagaaaugggaacgcu

SEQ ID NO: 531160 - RNA, 32 nt, Human
uguugagaccagucaugacagcauucaagauu

SEQ ID NO: 531161 - RNA, 32 nt, Human
uguugagagagaagaauggaaguuggauacac

SEQ ID NO: 531162 - RNA, 32 nt, Human
uguugagagcauuucagccagaggacuuugga

SEQ ID NO: 531163 - RNA, 18 nt, Human
uguugagagcgguguggu

SEQ ID NO: 531164 - RNA, 32 nt, Human
uguugagaggcugaggugggcagaucauuuga

SEQ ID NO: 531165 - RNA, 32 nt, Human
uguugagagggugucaaauugagaaccaggua

SEQ ID NO: 531166 - RNA, 32 nt, Human
uguugagaggucuuggugagggcucaacucaa

SEQ ID NO: 531167 - RNA, 32 nt, Human
uguugagauaaauaagugauauaaaacaugua

SEQ ID NO: 531168 - RNA, 21 nt, Human
uguugagaugcagauuccuca

SEQ ID NO: 531169 - RNA, 32 nt, Human
uguugagauuucuguguucuccacucuuccac

SEQ ID NO: 531170 - RNA, 32 nt, Human
uguugagcagggcgugguucuccagucugccc

SEQ ID NO: 531171 - RNA, 32 nt, Human
uguugagcauggucaguuuagccugcgaggcu

SEQ ID NO: 531172 - RNA, 32 nt, Human
uguugagccacccaucagacccucuuuagcug

SEQ ID NO: 531173 - RNA, 32 nt, Human
uguugagccaggagguugggcaaaggccggau

SEQ ID NO: 531174 - RNA, 32 nt, Human
uguugaggaaggagggaguagauggagggcuc

SEQ ID NO: 531175 - RNA, 32 nt, Human
uguugagggaaaagaauggugggcugggggcg

SEQ ID NO: 531176 - RNA, 32 nt, Human
uguugagggagagagacagaauccuggacucu

SEQ ID NO: 531177 - RNA, 32 nt, Human
uguugagggagggagagcagguuacuuggcaa

SEQ ID NO: 531178 - RNA, 32 nt, Human
uguugagggccgacugcugcucugccuuccuu

SEQ ID NO: 531179 - RNA, 32 nt, Human
uguugagucuagaauugcuguguuguucuuag

SEQ ID NO: 531180 - RNA, 32 nt, Human
uguugagucuccugccugcuugccaaaagcua

SEQ ID NO: 531181 - RNA, 32 nt, Human
uguugaguguguggauucccuuuuaagauaga

SEQ ID NO: 531182 - RNA, 32 nt, Human
uguugaguucugugccuggccuacagauuaac

SEQ ID NO: 531183 - RNA, 20 nt, Human
uguugaguuugugcuguggu

SEQ ID NO: 531184 - RNA, 32 nt, Human
uguugauacauuuugaaucuuuagacacuuac

SEQ ID NO: 531185 - RNA, 32 nt, Human
uguugauagagugcaucagaauuucaaaaggc

SEQ ID NO: 531186 - RNA, 32 nt, Human
uguugauaguagaagcagugguaguuguugua

SEQ ID NO: 531187 - RNA, 32 nt, Human
uguugaugaaguauacuuuuccccuguuaaac

SEQ ID NO: 531188 - RNA, 31 nt, Human
uguugaugacuucucuguuccacaggcccuc

SEQ ID NO: 531189 - RNA, 32 nt, Human
uguugaugagccacuguaccccgauaccacug

SEQ ID NO: 531190 - RNA, 32 nt, Human
uguugaugagcuauugagagcugcaguaguuu

SEQ ID NO: 531191 - RNA, 24 nt, Human
uguugaugaggcuggagugcagug

SEQ ID NO: 531192 - RNA, 32 nt, Human
uguugaugaugcccuggaaagacagagcccug

SEQ ID NO: 531193 - RNA, 32 nt, Human
uguugaugcccuuucugacuguguucucuguu

SEQ ID NO: 531194 - RNA, 22 nt, Human
uguugauggggaucccagcaga

SEQ ID NO: 531195 - RNA, 32 nt, Human
uguugauguguucugugucugucugucaccug

SEQ ID NO: 531196 - RNA, 32 nt, Human
uguugauguuaacugagcuacuagagauauuc

SEQ ID NO: 531197 - RNA, 32 nt, Human
uguugauuaaaacauuauagauuuucauguuc

SEQ ID NO: 531198 - RNA, 32 nt, Human
uguugauuaccucuugguuugacuucccaggg

SEQ ID NO: 531199 - RNA, 32 nt, Human
uguugauuccacugaaaccucuguucucauga

SEQ ID NO: 531200 - RNA, 32 nt, Human
uguugauuugacuuccccuuggaaaugaguau

SEQ ID NO: 531201 - RNA, 32 nt, Human
uguugauuuggcugagcagagcugaguuuugg

SEQ ID NO: 531202 - RNA, 32 nt, Human
uguugauuuucacugcaacucugccuuugugu

SEQ ID NO: 531203 - RNA, 32 nt, Human
uguugauuuuucuauuuauauuuccuuguaca

SEQ ID NO: 531204 - RNA, 32 nt, Human
uguugcaaauuccaccccuccuucccuggucc

SEQ ID NO: 531205 - RNA, 32 nt, Human
uguugcaacgucagaguaaaagaaggacccug

SEQ ID NO: 531206 - RNA, 32 nt, Human
uguugcaaucagggcucacugcagccucgacc

SEQ ID NO: 531207 - RNA, 32 nt, Human
uguugcacaauuucuggucaaucaaugcugac

SEQ ID NO: 531208 - RNA, 32 nt, Human
uguugcacacauaucacaucguuuaaauugca

SEQ ID NO: 531209 - RNA, 32 nt, Human
uguugcaccagaaagguccccacuagagcuaa

SEQ ID NO: 531210 - RNA, 32 nt, Human
uguugcacuagcuugggguagaugcugggggc

SEQ ID NO: 531211 - RNA, 32 nt, Human
uguugcacugaggauuuagggagagagcaaga

SEQ ID NO: 531212 - RNA, 32 nt, Human
uguugcagagccaguaaccccaguguuaucug

SEQ ID NO: 531213 - RNA, 32 nt, Human
uguugcagauuugccauuucuccauaauaugg

SEQ ID NO: 531214 - RNA, 32 nt, Human
uguugcagccagggggcuggauuucccggcug

SEQ ID NO: 531215 - RNA, 32 nt, Human
uguugcagccugguugagaaggagagaaaaag

SEQ ID NO: 531216 - RNA, 32 nt, Human
uguugcagcuaccugcacuucuagaugcuccc

SEQ ID NO: 531217 - RNA, 32 nt, Human
uguugcagcuaccugcacuucuagauucaucu

SEQ ID NO: 531218 - RNA, 32 nt, Human
uguugcagcugcaaggagaccaugccuguggg

SEQ ID NO: 531219 - RNA, 32 nt, Human
uguugcaggacuagcagguggauaguauauag

SEQ ID NO: 531220 - RNA, 32 nt, Human
uguugcaggagggagagggagagcuucuuuag

SEQ ID NO: 531221 - RNA, 32 nt, Human
uguugcaggcacuccagccuggcgacagagcg

SEQ ID NO: 531222 - RNA, 24 nt, Human
uguugcaggggcuggugugcagug

SEQ ID NO: 531223 - RNA, 32 nt, Human
uguugcagguguccaccauugcgaugcagcag

SEQ ID NO: 531224 - RNA, 32 nt, Human
uguugcaguacccccauucacccacaaaaugc

SEQ ID NO: 531225 - RNA, 32 nt, Human
uguugcagugugccucugccccaugggcccga

SEQ ID NO: 531226 - RNA, 32 nt, Human
uguugcauacaguucugcuguaaacuuucuug

SEQ ID NO: 531227 - RNA, 32 nt, Human
uguugcauauaccuuaaucuuugauaugaaua

SEQ ID NO: 531228 - RNA, 32 nt, Human
uguugcaucccccuuagaauguuucuauuucc

SEQ ID NO: 531229 - RNA, 32 nt, Human
uguugcauuccaggaacuagcccaggcccugg

SEQ ID NO: 531230 - RNA, 32 nt, Human
uguugcauucccagcacacaguacaguuauuc

SEQ ID NO: 531231 - RNA, 32 nt, Human
uguugcauuucuuuuaugaugacuguaguuga

SEQ ID NO: 531232 - RNA, 32 nt, Human
uguugccaaaggacacauucccagaugggauu

SEQ ID NO: 531233 - RNA, 24 nt, Human
uguugccaaggcuggaaugcagug

SEQ ID NO: 531234 - RNA, 24 nt, Human
uguugccaaggcuggagugcagug

SEQ ID NO: 531235 - RNA, 32 nt, Human
uguugccacccaggugauguuaguguuuuaag

SEQ ID NO: 531236 - RNA, 32 nt, Human
uguugccacugcacucuggccugggcaacaga

SEQ ID NO: 531237 - RNA, 32 nt, Human
uguugccagaaucagacugcccuagaacagaa

SEQ ID NO: 531238 - RNA, 23 nt, Human
uguugccagacuggagugcagug

SEQ ID NO: 531239 - RNA, 32 nt, Human
uguugccagccauguugcccaggcuggucgug

SEQ ID NO: 531240 - RNA, 23 nt, Human
uguugccaggccagagugcagug

SEQ ID NO: 531241 - RNA, 23 nt, Human
uguugccaggcuagagugcagug

SEQ ID NO: 531242 - RNA, 23 nt, Human
uguugccaggcuggaaugcagug

SEQ ID NO: 531243 - RNA, 23 nt, Human
uguugccaggcuggaaugccgug

SEQ ID NO: 531244 - RNA, 23 nt, Human
uguugccaggcuggagggcagug

SEQ ID NO: 531245 - RNA, 22 nt, Human
uguugccaggcuggagugcagu

SEQ ID NO: 531246 - RNA, 23 nt, Human
uguugccaggcuggagugcagug

SEQ ID NO: 531247 - RNA, 23 nt, Human
uguugccaggcuggggugcagug

SEQ ID NO: 531248 - RNA, 32 nt, Human
uguugccauaaauauguaagugucaauaccaa

SEQ ID NO: 531249 - RNA, 32 nt, Human
uguugccaucagggugcacacagcaggugcag

SEQ ID NO: 531250 - RNA, 32 nt, Human
uguugccaugcuguggaagcucugccuuuuug

SEQ ID NO: 531251 - RNA, 32 nt, Human
uguugccauugacagcguugugaauggucauc

SEQ ID NO: 531252 - RNA, 32 nt, Human
uguugccauuuuaccccagcaguuccuuuucu

SEQ ID NO: 531253 - RNA, 24 nt, Human
uguugcccaaauucagugucagug

SEQ ID NO: 531254 - RNA, 24 nt, Human
uguugcccaaccuggagugcagug

SEQ ID NO: 531255 - RNA, 23 nt, Human
uguugcccaagcuggaaugcagu

SEQ ID NO: 531256 - RNA, 24 nt, Human
uguugcccaagcuggaaugcagug

SEQ ID NO: 531257 - RNA, 23 nt, Human
uguugcccaagcuggaguacagu

SEQ ID NO: 531258 - RNA, 24 nt, Human
uguugcccaagcuggagugaagug

SEQ ID NO: 531259 - RNA, 24 nt, Human
uguugcccaagcuggagugcaaug

SEQ ID NO: 531260 - RNA, 23 nt, Human
uguugcccaagcuggagugcagu

SEQ ID NO: 531261 - RNA, 24 nt, Human
uguugcccaagcuggagugcagug

SEQ ID NO: 531262 - RNA, 20 nt, Human
uguugcccaagcugguguca

SEQ ID NO: 531263 - RNA, 21 nt, Human
uguugcccaagcuggugucaa

SEQ ID NO: 531264 - RNA, 24 nt, Human
uguugcccaagcuugagggcagug

SEQ ID NO: 531265 - RNA, 24 nt, Human
uguugcccaagguagagugcagug

SEQ ID NO: 531266 - RNA, 19 nt, Human
uguugcccaaggugugcag

SEQ ID NO: 531267 - RNA, 21 nt, Human
uguugcccaaguuggagugca

SEQ ID NO: 531268 - RNA, 23 nt, Human
uguugcccaaguuggagugcaau

SEQ ID NO: 531269 - RNA, 32 nt, Human
uguugcccaaguuggagugcaaucuuggcuca

SEQ ID NO: 531270 - RNA, 24 nt, Human
uguugcccaaguuggagugcagug

SEQ ID NO: 531271 - RNA, 32 nt, Human
uguugcccaaugagccuucuuucugcccucca

SEQ ID NO: 531272 - RNA, 24 nt, Human
uguugcccacauuggagugcagug

SEQ ID NO: 531273 - RNA, 24 nt, Human
uguugcccacgcaggagugcagug

SEQ ID NO: 531274 - RNA, 24 nt, Human
uguugcccacgcuggagugcaaug

SEQ ID NO: 531275 - RNA, 21 nt, Human
uguugcccagacuagaguaca

SEQ ID NO: 531276 - RNA, 23 nt, Human
uguugcccagacuagaguacaau

SEQ ID NO: 531277 - RNA, 23 nt, Human
uguugcccagacuagagugcagu

SEQ ID NO: 531278 - RNA, 24 nt, Human
uguugcccagacuagagugcagug

SEQ ID NO: 531279 - RNA, 23 nt, Human
uguugcccagacuggagggcagu

SEQ ID NO: 531280 - RNA, 24 nt, Human
uguugcccagacuggagggcagug

SEQ ID NO: 531281 - RNA, 24 nt, Human
uguugcccagacuggagugcaaug

SEQ ID NO: 531282 - RNA, 23 nt, Human
uguugcccagacuggagugcagu

SEQ ID NO: 531283 - RNA, 24 nt, Human
uguugcccagacuggagugcagug

SEQ ID NO: 531284 - RNA, 22 nt, Human
uguugcccagaggaugugcagu

SEQ ID NO: 531285 - RNA, 21 nt, Human
uguugcccagccuggagugca

SEQ ID NO: 531286 - RNA, 23 nt, Human
uguugcccagccuggagugcaau

SEQ ID NO: 531287 - RNA, 32 nt, Human
uguugcccagccuggccaacauggugaaaccc

SEQ ID NO: 531288 - RNA, 18 nt, Human
uguugcccagcuggacag

SEQ ID NO: 531289 - RNA, 23 nt, Human
uguugcccagcuggagugcagug

SEQ ID NO: 531290 - RNA, 24 nt, Human
uguugcccaggagggagugcagug

SEQ ID NO: 531291 - RNA, 24 nt, Human
uguugcccaggauggagugcagug

SEQ ID NO: 531292 - RNA, 24 nt, Human
uguugcccaggcaagagugcagug

SEQ ID NO: 531293 - RNA, 24 nt, Human
uguugcccaggcaggaguacagug

SEQ ID NO: 531294 - RNA, 24 nt, Human
uguugcccaggcaguagugcagug

SEQ ID NO: 531295 - RNA, 23 nt, Human
uguugcccaggcggaguacaaug

SEQ ID NO: 531296 - RNA, 22 nt, Human
uguugcccaggcuagagcgcag

SEQ ID NO: 531297 - RNA, 21 nt, Human
uguugcccaggcuagagugca

SEQ ID NO: 531298 - RNA, 24 nt, Human
uguugcccaggcuagagugcaaug

SEQ ID NO: 531299 - RNA, 24 nt, Human
uguugcccaggcuagagugcacug

SEQ ID NO: 531300 - RNA, 22 nt, Human
uguugcccaggcuagagugcag

SEQ ID NO: 531301 - RNA, 23 nt, Human
uguugcccaggcuagagugcagu

SEQ ID NO: 531302 - RNA, 24 nt, Human
uguugcccaggcuagagugcagug

SEQ ID NO: 531303 - RNA, 24 nt, Human
uguugcccaggcuagcaugcaaug

SEQ ID NO: 531304 - RNA, 20 nt, Human
uguugcccaggcuagucugg

SEQ ID NO: 531305 - RNA, 19 nt, Human
uguugcccaggcugaagug

SEQ ID NO: 531306 - RNA, 20 nt, Human
uguugcccaggcugaagugc

SEQ ID NO: 531307 - RNA, 24 nt, Human
uguugcccaggcugaagugcaaug

SEQ ID NO: 531308 - RNA, 23 nt, Human
uguugcccaggcugaagugcagu

SEQ ID NO: 531309 - RNA, 24 nt, Human
uguugcccaggcugaagugcagug

SEQ ID NO: 531310 - RNA, 24 nt, Human
uguugcccaggcugaagugccaug

SEQ ID NO: 531311 - RNA, 24 nt, Human
uguugcccaggcugaaguguagug

SEQ ID NO: 531312 - RNA, 21 nt, Human
uguugcccaggcugaauucag

SEQ ID NO: 531313 - RNA, 24 nt, Human
uguugcccaggcugcagugcagug

SEQ ID NO: 531314 - RNA, 21 nt, Human
uguugcccaggcugcucucag

SEQ ID NO: 531315 - RNA, 22 nt, Human
uguugcccaggcugcuggagug

SEQ ID NO: 531316 - RNA, 23 nt, Human
uguugcccaggcugcuggagugc

SEQ ID NO: 531317 - RNA, 27 nt, Human
uguugcccaggcugcuggagugccgug

SEQ ID NO: 531318 - RNA, 22 nt, Human
uguugcccaggcuggaaauggc

SEQ ID NO: 531319 - RNA, 20 nt, Human
uguugcccaggcuggaagug

SEQ ID NO: 531320 - RNA, 21 nt, Human
uguugcccaggcuggaagugu

SEQ ID NO: 531321 - RNA, 23 nt, Human
uguugcccaggcuggaauacagu

SEQ ID NO: 531322 - RNA, 24 nt, Human
uguugcccaggcuggaauacagug

SEQ ID NO: 531323 - RNA, 24 nt, Human
uguugcccaggcuggaaugcaaug

SEQ ID NO: 531324 - RNA, 23 nt, Human
uguugcccaggcuggaaugcagu

SEQ ID NO: 531325 - RNA, 24 nt, Human
uguugcccaggcuggaaugcagug

SEQ ID NO: 531326 - RNA, 24 nt, Human
uguugcccaggcuggacugcagug

SEQ ID NO: 531327 - RNA, 24 nt, Human
uguugcccaggcuggagagcagug

SEQ ID NO: 531328 - RNA, 23 nt, Human
uguugcccaggcuggagcgcagu

SEQ ID NO: 531329 - RNA, 24 nt, Human
uguugcccaggcuggagcgcagug

SEQ ID NO: 531330 - RNA, 24 nt, Human
uguugcccaggcuggagggcaaug

SEQ ID NO: 531331 - RNA, 24 nt, Human
uguugcccaggcuggagggcagug

SEQ ID NO: 531332 - RNA, 21 nt, Human
uguugcccaggcuggaguaca

SEQ ID NO: 531333 - RNA, 23 nt, Human
uguugcccaggcuggaguacaau

SEQ ID NO: 531334 - RNA, 24 nt, Human
uguugcccaggcuggaguacaaug

SEQ ID NO: 531335 - RNA, 23 nt, Human
uguugcccaggcuggaguacagu

SEQ ID NO: 531336 - RNA, 24 nt, Human
uguugcccaggcuggaguacagug

SEQ ID NO: 531337 - RNA, 24 nt, Human
uguugcccaggcuggaguacauug

SEQ ID NO: 531338 - RNA, 23 nt, Human
uguugcccaggcuggaguauagu

SEQ ID NO: 531339 - RNA, 27 nt, Human
uguugcccaggcuggaguauaguagug

SEQ ID NO: 531340 - RNA, 19 nt, Human
uguugcccaggcuggagug

SEQ ID NO: 531341 - RNA, 24 nt, Human
uguugcccaggcuggagugaagug

SEQ ID NO: 531342 - RNA, 20 nt, Human
uguugcccaggcuggagugc

SEQ ID NO: 531343 - RNA, 21 nt, Human
uguugcccaggcuggagugca

SEQ ID NO: 531344 - RNA, 22 nt, Human
uguugcccaggcuggagugcaa

SEQ ID NO: 531345 - RNA, 27 nt, Human
uguugcccaggcuggagugcaacggug

SEQ ID NO: 531346 - RNA, 23 nt, Human
uguugcccaggcuggagugcaau

SEQ ID NO: 531347 - RNA, 24 nt, Human
uguugcccaggcuggagugcaaug

SEQ ID NO: 531348 - RNA, 22 nt, Human
uguugcccaggcuggagugcag

SEQ ID NO: 531349 - RNA, 23 nt, Human
uguugcccaggcuggagugcagu

SEQ ID NO: 531350 - RNA, 24 nt, Human
uguugcccaggcuggagugcagug

SEQ ID NO: 531351 - RNA, 24 nt, Human
uguugcccaggcuggagugcauug

SEQ ID NO: 531352 - RNA, 24 nt, Human
uguugcccaggcuggagugccuug

SEQ ID NO: 531353 - RNA, 24 nt, Human
uguugcccaggcuggagugcgaug

SEQ ID NO: 531354 - RNA, 23 nt, Human
uguugcccaggcuggagugcggu

SEQ ID NO: 531355 - RNA, 24 nt, Human
uguugcccaggcuggagugcggug

SEQ ID NO: 531356 - RNA, 23 nt, Human
uguugcccaggcuggaguggagu

SEQ ID NO: 531357 - RNA, 24 nt, Human
uguugcccaggcuggaguggagug

SEQ ID NO: 531358 - RNA, 22 nt, Human
uguugcccaggcuggaguguag

SEQ ID NO: 531359 - RNA, 23 nt, Human
uguugcccaggcuggaguguagu

SEQ ID NO: 531360 - RNA, 24 nt, Human
uguugcccaggcuggaguguagug

SEQ ID NO: 531361 - RNA, 21 nt, Human
uguugcccaggcuggagugug

SEQ ID NO: 531362 - RNA, 24 nt, Human
uguugcccaggcuggagugugaug

SEQ ID NO: 531363 - RNA, 24 nt, Human
uguugcccaggcuggaguguggug

SEQ ID NO: 531364 - RNA, 24 nt, Human
uguugcccaggcuggcgugcagug

SEQ ID NO: 531365 - RNA, 22 nt, Human
uguugcccaggcugggagggca

SEQ ID NO: 531366 - RNA, 24 nt, Human
uguugcccaggcugggagggcaau

SEQ ID NO: 531367 - RNA, 32 nt, Human
uguugcccaggcugggagggcaauggcaccgu

SEQ ID NO: 531368 - RNA, 23 nt, Human
uguugcccaggcuggggugcagu

SEQ ID NO: 531369 - RNA, 24 nt, Human
uguugcccaggcuggggugcagug

SEQ ID NO: 531370 - RNA, 21 nt, Human
uguugcccaggcuggucgcga

SEQ ID NO: 531371 - RNA, 20 nt, Human
uguugcccaggcuggucgug

SEQ ID NO: 531372 - RNA, 21 nt, Human
uguugcccaggcuggucucaa

SEQ ID NO: 531373 - RNA, 23 nt, Human
uguugcccaggcuggucucaagu

SEQ ID NO: 531374 - RNA, 22 nt, Human
uguugcccaggcuggucucaau

SEQ ID NO: 531375 - RNA, 21 nt, Human
uguugcccaggcuggucucag

SEQ ID NO: 531376 - RNA, 22 nt, Human
uguugcccaggcuggucuccaa

SEQ ID NO: 531377 - RNA, 23 nt, Human
uguugcccaggcuggucuccaau

SEQ ID NO: 531378 - RNA, 21 nt, Human
uguugcccaggcuggucucgg

SEQ ID NO: 531379 - RNA, 22 nt, Human
uguugcccaggcuggucugaag

SEQ ID NO: 531380 - RNA, 21 nt, Human
uguugcccaggcuggucuggu

SEQ ID NO: 531381 - RNA, 22 nt, Human
uguugcccaggcuggucuuaag

SEQ ID NO: 531382 - RNA, 22 nt, Human
uguugcccaggcuggucuugag

SEQ ID NO: 531383 - RNA, 20 nt, Human
uguugcccaggcugguguca

SEQ ID NO: 531384 - RNA, 21 nt, Human
uguugcccaggcuggugucaa

SEQ ID NO: 531385 - RNA, 20 nt, Human
uguugcccaggcuggugucg

SEQ ID NO: 531386 - RNA, 21 nt, Human
uguugcccaggcuggugucga

SEQ ID NO: 531387 - RNA, 24 nt, Human
uguugcccaggcuggugugcaaug

SEQ ID NO: 531388 - RNA, 32 nt, Human
uguugcccaggcugguugcaaacuucuggccu

SEQ ID NO: 531389 - RNA, 21 nt, Human
uguugcccaggcugguuucaa

SEQ ID NO: 531390 - RNA, 24 nt, Human
uguugcccaggcuguaguacaaug

SEQ ID NO: 531391 - RNA, 24 nt, Human
uguugcccaggcuguagugcagug

SEQ ID NO: 531392 - RNA, 24 nt, Human
uguugcccaggcuugagugcagug

SEQ ID NO: 531393 - RNA, 25 nt, Human
uguugcccagggcuggagugcagug

SEQ ID NO: 531394 - RNA, 32 nt, Human
uguugcccagggcuggagugcaguggcaugau

SEQ ID NO: 531395 - RNA, 24 nt, Human
uguugcccaggguggagugcagug

SEQ ID NO: 531396 - RNA, 21 nt, Human
uguugcccaggguggucucaa

SEQ ID NO: 531397 - RNA, 22 nt, Human
uguugcccaggguggucuguaa

SEQ ID NO: 531398 - RNA, 19 nt, Human
uguugcccagguccugcaa

SEQ ID NO: 531399 - RNA, 24 nt, Human
uguugcccagguuagagugcagug

SEQ ID NO: 531400 - RNA, 26 nt, Human
uguugcccagguucuagagugcagug

SEQ ID NO: 531401 - RNA, 24 nt, Human
uguugcccagguuggagugcagug

SEQ ID NO: 531402 - RNA, 21 nt, Human
uguugcccagguuggagugua

SEQ ID NO: 531403 - RNA, 23 nt, Human
uguugcccagguuggaguguaau

SEQ ID NO: 531404 - RNA, 22 nt, Human
uguugcccagucuggaguacag

SEQ ID NO: 531405 - RNA, 24 nt, Human
uguugcccagucuggaguucagug

SEQ ID NO: 531406 - RNA, 24 nt, Human
uguugcccaugcuggagggcagug

SEQ ID NO: 531407 - RNA, 24 nt, Human
uguugcccaugcuggagugcaaug

SEQ ID NO: 531408 - RNA, 24 nt, Human
uguugcccaugcuggagugcauug

SEQ ID NO: 531409 - RNA, 24 nt, Human
uguugcccauucuggagugcagug

SEQ ID NO: 531410 - RNA, 32 nt, Human
uguugccccacacagccuccugcugcaggugc

SEQ ID NO: 531411 - RNA, 24 nt, Human
uguugccccagcuugagugcagug

SEQ ID NO: 531412 - RNA, 25 nt, Human
uguugccccaggcuggagugcagug

SEQ ID NO: 531413 - RNA, 32 nt, Human
uguugccccaggcuggagugcaguggcgugau

SEQ ID NO: 531414 - RNA, 32 nt, Human
uguugccccaggcuggagugcaguggugugau

SEQ ID NO: 531415 - RNA, 32 nt, Human
uguugccccugccucuccuccuuucucucucc

SEQ ID NO: 531416 - RNA, 32 nt, Human
uguugccccuugugggcaaccaugaggggcau

SEQ ID NO: 531417 - RNA, 24 nt, Human
uguugcccgggcuggaaugcaaug

SEQ ID NO: 531418 - RNA, 24 nt, Human
uguugcccgggcuggagugcaaug

SEQ ID NO: 531419 - RNA, 22 nt, Human
uguugcccgggcuggagugcag

SEQ ID NO: 531420 - RNA, 23 nt, Human
uguugcccucacuagagugcagu

SEQ ID NO: 531421 - RNA, 32 nt, Human
uguugcccuccaggggccuggcacagcuggcc

SEQ ID NO: 531422 - RNA, 32 nt, Human
uguugcccugacagugcauggaaaggacguug

SEQ ID NO: 531423 - RNA, 24 nt, Human
uguugcccugacuggaguucagug

SEQ ID NO: 531424 - RNA, 24 nt, Human
uguugcccuggcuggacugcagug

SEQ ID NO: 531425 - RNA, 24 nt, Human
uguugcccuggcuggaguucagug

SEQ ID NO: 531426 - RNA, 20 nt, Human
uguugcccuuaaguacagug

SEQ ID NO: 531427 - RNA, 32 nt, Human
uguugcccuugugcuccagucauugcacaagg

SEQ ID NO: 531428 - RNA, 32 nt, Human
uguugcccuuuggagcuuggugaggagggugg

SEQ ID NO: 531429 - RNA, 32 nt, Human
uguugccgacacgcccucccaacugcagacau

SEQ ID NO: 531430 - RNA, 24 nt, Human
uguugccgaggcuggagugcaaug

SEQ ID NO: 531431 - RNA, 32 nt, Human
uguugccgguucauggauuacuucucuauaaa

SEQ ID NO: 531432 - RNA, 32 nt, Human
uguugccguccacuguggcggguuucuuccug

SEQ ID NO: 531433 - RNA, 24 nt, Human
uguugccuaggccagagugcagug

SEQ ID NO: 531434 - RNA, 23 nt, Human
uguugccuaggcggaguacagug

SEQ ID NO: 531435 - RNA, 24 nt, Human
uguugccuaggcuggaguacagug

SEQ ID NO: 531436 - RNA, 24 nt, Human
uguugccuaggcuggagugaagug

SEQ ID NO: 531437 - RNA, 24 nt, Human
uguugccuaggcuggagugcaaug

SEQ ID NO: 531438 - RNA, 24 nt, Human
uguugccuaggcuggagugcagug

SEQ ID NO: 531439 - RNA, 32 nt, Human
uguugccucacugcggccucccgaguccaaag

SEQ ID NO: 531440 - RNA, 32 nt, Human
uguugccucgucggaguuugcuggugaugaca

SEQ ID NO: 531441 - RNA, 24 nt, Human
uguugccugggcuggaaugcagug

SEQ ID NO: 531442 - RNA, 32 nt, Human
uguugccugggcuggagaacaguggcaccauc

SEQ ID NO: 531443 - RNA, 24 nt, Human
uguugccugggcuggagugcagug

SEQ ID NO: 531444 - RNA, 32 nt, Human
uguugccugggcugguugcaaacucuugagcu

SEQ ID NO: 531445 - RNA, 32 nt, Human
uguugccuggggaacaggagagcugcugcagg

SEQ ID NO: 531446 - RNA, 32 nt, Human
uguugccugugaggagcuuucuggcaugugau

SEQ ID NO: 531447 - RNA, 32 nt, Human
uguugccugugaguucugccucgcuggccaga

SEQ ID NO: 531448 - RNA, 32 nt, Human
uguugccuguguagagcaaguuacggugguac

SEQ ID NO: 531449 - RNA, 32 nt, Human
uguugccuguucucaaauaucuguuccaacca

SEQ ID NO: 531450 - RNA, 32 nt, Human
uguugccuucauuccugagcagguaucauccu

SEQ ID NO: 531451 - RNA, 32 nt, Human
uguugccuuccaggggccaagagcugcucuga

SEQ ID NO: 531452 - RNA, 32 nt, Human
uguugccuuuccaagugaccucuccucuucuu

SEQ ID NO: 531453 - RNA, 32 nt, Human
uguugccuuugguuagggaacacagagugcuu

SEQ ID NO: 531454 - RNA, 32 nt, Human
uguugcgacgcgggcuucuggagcuugucacc

SEQ ID NO: 531455 - RNA, 32 nt, Human
uguugcgaggaaccugggcucugacucgaaca

SEQ ID NO: 531456 - RNA, 32 nt, Human
uguugcgcaucuccuccacguuuuccuggagu

SEQ ID NO: 531457 - RNA, 32 nt, Human
uguugcgugccuguagucccagcuacuuggga

SEQ ID NO: 531458 - RNA, 22 nt, Human
uguugcuacuaaaaauacaaaa

SEQ ID NO: 531459 - RNA, 32 nt, Human
uguugcuacuaaaaauacaaaaauuggcuggg

SEQ ID NO: 531460 - RNA, 23 nt, Human
uguugcuaggcuggagugcagug

SEQ ID NO: 531461 - RNA, 32 nt, Human
uguugcuaucauccuccuuucucuuauugcca

SEQ ID NO: 531462 - RNA, 24 nt, Human
uguugcucaagcuggaguggagug

SEQ ID NO: 531463 - RNA, 32 nt, Human
uguugcucagagugaagagugaagagcauuug

SEQ ID NO: 531464 - RNA, 24 nt, Human
uguugcucaggcuggaguacagug

SEQ ID NO: 531465 - RNA, 24 nt, Human
uguugcucaggcuggauugcagug

SEQ ID NO: 531466 - RNA, 32 nt, Human
uguugcucauucucucacguuauuucauucuu

SEQ ID NO: 531467 - RNA, 32 nt, Human
uguugcuccaguauuaaccucuguggguggcc

SEQ ID NO: 531468 - RNA, 32 nt, Human
uguugcucggcccagguuggggagaggacgga

SEQ ID NO: 531469 - RNA, 32 nt, Human
uguugcucuaauucugugccucugugcauuaa

SEQ ID NO: 531470 - RNA, 32 nt, Human
uguugcucuggcuuccuuucauugucuuaggc

SEQ ID NO: 531471 - RNA, 24 nt, Human
uguugcugaggcuggagugcagug

SEQ ID NO: 531472 - RNA, 32 nt, Human
uguugcugaggcuggagugcagugaugugauc

SEQ ID NO: 531473 - RNA, 32 nt, Human
uguugcugauucaagaaacagaaguagaagag

SEQ ID NO: 531474 - RNA, 32 nt, Human
uguugcugcacuccagccugagugacagagug

SEQ ID NO: 531475 - RNA, 32 nt, Human
uguugcugcaucuccccucagauuccaccuag

SEQ ID NO: 531476 - RNA, 32 nt, Human
uguugcugcccaacuucaacauucauaauggc

SEQ ID NO: 531477 - RNA, 32 nt, Human
uguugcugcccaggcucuagaucacauggcau

SEQ ID NO: 531478 - RNA, 31 nt, Human
uguugcugccucucugugcuuuuggccucug

SEQ ID NO: 531479 - RNA, 32 nt, Human
uguugcugcgcacaccuguacucuccaaugaa

SEQ ID NO: 531480 - RNA, 32 nt, Human
uguugcugcuguaugcguuccauugugggaca

SEQ ID NO: 531481 - RNA, 32 nt, Human
uguugcuggcuggucuugaacuucugggguca

SEQ ID NO: 531482 - RNA, 32 nt, Human
uguugcuguagacugcugcgcaguccugggug

SEQ ID NO: 531483 - RNA, 32 nt, Human
uguugcuguauuggacagcacagguauagaac

SEQ ID NO: 531484 - RNA, 32 nt, Human
uguugcugugguggagugaugcagugggcacu

SEQ ID NO: 531485 - RNA, 32 nt, Human
uguugcuguugcccuguuuccugcugcuuugu

SEQ ID NO: 531486 - RNA, 32 nt, Human
uguugcuucccuccucccauuuucuugucugu

SEQ ID NO: 531487 - RNA, 32 nt, Human
uguugcuuccuucacagcaugucucaccaucu

SEQ ID NO: 531488 - RNA, 23 nt, Human
uguugcuucucucuuacuagaca

SEQ ID NO: 531489 - RNA, 32 nt, Human
uguugcuucuuugccuguuccugcuuucucuu

SEQ ID NO: 531490 - RNA, 32 nt, Human
uguugcuugacuccuuccauccuuccugaccu

SEQ ID NO: 531491 - RNA, 32 nt, Human
uguugcuugacuucgggggcacugugagccua

SEQ ID NO: 531492 - RNA, 32 nt, Human
uguugcuugcacuccagccugggugacagagu

SEQ ID NO: 531493 - RNA, 32 nt, Human
uguugcuuggaaggcauccauagcugcauuuu

SEQ ID NO: 531494 - RNA, 32 nt, Human
uguugcuugggcuccugggagcugcaguugga

SEQ ID NO: 531495 - RNA, 24 nt, Human
uguugcuugggcugcaaugcagug

SEQ ID NO: 531496 - RNA, 32 nt, Human
uguugcuuuaucucccccucccugcauguguc

SEQ ID NO: 531497 - RNA, 32 nt, Human
uguugcuuucagacugaguugcaugucacucu

SEQ ID NO: 531498 - RNA, 32 nt, Human
uguugcuuuccagagguguguggcucuuaagu

SEQ ID NO: 531499 - RNA, 32 nt, Human
uguugcuuucucguguaguuguucacaguagu

SEQ ID NO: 531500 - RNA, 32 nt, Human
uguugcuuugcugccagauguucaucugcuug

SEQ ID NO: 531501 - RNA, 32 nt, Human
uguuggaacuucugaccugucagaaagauuuu

SEQ ID NO: 531502 - RNA, 32 nt, Human
uguuggaagaaccaaugaaacacacacuuacu

SEQ ID NO: 531503 - RNA, 32 nt, Human
uguuggaagaauuccuugauuggaaauuguac

SEQ ID NO: 531504 - RNA, 32 nt, Human
uguuggaagaggaggcaggggaggguggccag

SEQ ID NO: 531505 - RNA, 20 nt, Human
uguuggaagauguaggugag

SEQ ID NO: 531506 - RNA, 32 nt, Human
uguuggaauggaacccuugcuauaguagugac

SEQ ID NO: 531507 - RNA, 23 nt, Human
uguuggacaaaccgagugcaaug

SEQ ID NO: 531508 - RNA, 32 nt, Human
uguuggaccuuaagcaaaucacuuuccugauc

SEQ ID NO: 531509 - RNA, 32 nt, Human
uguuggacguggagcggcgccgccaccgcgcc

SEQ ID NO: 531510 - RNA, 21 nt, Human
uguuggagaccaggaacaauc

SEQ ID NO: 531511 - RNA, 32 nt, Human
uguuggagagagaagggcuuagguagcaggga

SEQ ID NO: 531512 - RNA, 32 nt, Human
uguuggagagagaccugugcuuauuggaugga

SEQ ID NO: 531513 - RNA, 32 nt, Human
uguuggagagggcuuucagcuccccuccuccc

SEQ ID NO: 531514 - RNA, 32 nt, Human
uguuggagauccuucaggcaguaagggagagu

SEQ ID NO: 531515 - RNA, 23 nt, Human
uguuggagcaggcaggcaaaggg

SEQ ID NO: 531516 - RNA, 21 nt, Human
uguuggagcucagggaaggga

SEQ ID NO: 531517 - RNA, 32 nt, Human
uguuggagcugcagagagaccccaaagguagu

SEQ ID NO: 531518 - RNA, 32 nt, Human
uguuggaggaagacgcggucaugagggcugaa

SEQ ID NO: 531519 - RNA, 31 nt, Human
uguuggagggaaccuguuucacuauggccuc

SEQ ID NO: 531520 - RNA, 32 nt, Human
uguuggagggagaagcuggagacuuccagcuc

SEQ ID NO: 531521 - RNA, 32 nt, Human
uguuggagggcacuuagugggguugaaguaug

SEQ ID NO: 531522 - RNA, 32 nt, Human
uguuggagggggcagcugaaggagaacagcaa

SEQ ID NO: 531523 - RNA, 32 nt, Human
uguuggaggggugggagggaggaacaauuuuu

SEQ ID NO: 531524 - RNA, 32 nt, Human
uguuggagggucuccuggaggcugccaagggc

SEQ ID NO: 531525 - RNA, 32 nt, Human
uguuggaguaggggcagagggagggagccaag

SEQ ID NO: 531526 - RNA, 32 nt, Human
uguuggaguccuggaagagagagaugagccag

SEQ ID NO: 531527 - RNA, 32 nt, Human
uguuggauguguauagugucuuugccauuuua

SEQ ID NO: 531528 - RNA, 32 nt, Human
uguuggauuccagauugcuauuguaaaaucuc

SEQ ID NO: 531529 - RNA, 32 nt, Human
uguuggauuuuagcaaaagcauccaagaaaaa

SEQ ID NO: 531530 - RNA, 32 nt, Human
uguuggauuuucucagaugccuuuacacgcug

SEQ ID NO: 531531 - RNA, 32 nt, Human
uguuggcacagcugugcggugcuggcuguccc

SEQ ID NO: 531532 - RNA, 32 nt, Human
uguuggcaccuugagacuucccagcuuccaga

SEQ ID NO: 531533 - RNA, 23 nt, Human
uguuggcagacuagaguacagug

SEQ ID NO: 531534 - RNA, 32 nt, Human
uguuggcagggaggccuccuggaaccagucag

SEQ ID NO: 531535 - RNA, 32 nt, Human
uguuggcagucagagaugacugugcuguguca

SEQ ID NO: 531536 - RNA, 32 nt, Human
uguuggcauauuccccuuuucuuagauucuua

SEQ ID NO: 531537 - RNA, 32 nt, Human
uguuggcauggcuuugccacuuuaaaagugcc

SEQ ID NO: 531538 - RNA, 24 nt, Human
uguuggccaaaagcugcuuuccau

SEQ ID NO: 531539 - RNA, 28 nt, Human
uguuggccaagugcuuuucuucuugggc

SEQ ID NO: 531540 - RNA, 32 nt, Human
uguuggccacgcugcagaaaugagcuggagcu

SEQ ID NO: 531541 - RNA, 32 nt, Human
uguuggccaggaguucaaaaccagccugacca

SEQ ID NO: 531542 - RNA, 32 nt, Human
uguuggccaggauggucuccaucucuugaccu

SEQ ID NO: 531543 - RNA, 24 nt, Human
uguuggccaggcuggaaugcagug

SEQ ID NO: 531544 - RNA, 23 nt, Human
uguuggccaggcuggagugcagu

SEQ ID NO: 531545 - RNA, 24 nt, Human
uguuggccaggcuggagugcagug

SEQ ID NO: 531546 - RNA, 22 nt, Human
uguuggccaggcuggagugcgg

SEQ ID NO: 531547 - RNA, 32 nt, Human
uguuggccaggcuggucucacacuccugaccu

SEQ ID NO: 531548 - RNA, 32 nt, Human
uguuggccaugucuccccaacuccacaauauc

SEQ ID NO: 531549 - RNA, 32 nt, Human
uguuggccucgggggcgcgccgccgcggagac

SEQ ID NO: 531550 - RNA, 32 nt, Human
uguuggccucuggggcugucauggcccacgcg

SEQ ID NO: 531551 - RNA, 32 nt, Human
uguuggccucuuucugggucucugccuggguc

SEQ ID NO: 531552 - RNA, 22 nt, Human
uguuggccuuacaccacugcca

SEQ ID NO: 531553 - RNA, 32 nt, Human
uguuggccuuucuuagccuuuuucuguuucca

SEQ ID NO: 531554 - RNA, 32 nt, Human
uguuggcgggggcggagggcaggggaacggga

SEQ ID NO: 531555 - RNA, 32 nt, Human
uguuggcuaggauggucuccaucucuugaccu

SEQ ID NO: 531556 - RNA, 24 nt, Human
uguuggcuaggcuggaguaaaaug

SEQ ID NO: 531557 - RNA, 32 nt, Human
uguuggcucaacaauucuuuguuuuuaauugc

SEQ ID NO: 531558 - RNA, 32 nt, Human
uguuggcucacugcaaccuccaacucccuggu

SEQ ID NO: 531559 - RNA, 32 nt, Human
uguuggcuccaucucuccacacugccucuuuc

SEQ ID NO: 531560 - RNA, 32 nt, Human
uguuggcuccccucaccugucgguugccuucu

SEQ ID NO: 531561 - RNA, 21 nt, Human
uguuggcucccgccuguaauc

SEQ ID NO: 531562 - RNA, 32 nt, Human
uguuggcucuagacuggucucaucuccauugc

SEQ ID NO: 531563 - RNA, 32 nt, Human
uguuggcugccuggcccaugugcccacugucu

SEQ ID NO: 531564 - RNA, 32 nt, Human
uguuggcugcuugagcugggauauucaucuuu

SEQ ID NO: 531565 - RNA, 20 nt, Human
uguuggcuguugccuggaga

SEQ ID NO: 531566 - RNA, 32 nt, Human
uguuggcuuuaguguaagacaaggucacugug

SEQ ID NO: 531567 - RNA, 32 nt, Human
uguugggaaacagggagugagugaagggaacc

SEQ ID NO: 531568 - RNA, 21 nt, Human
uguugggaaggaaccuguggu

SEQ ID NO: 531569 - RNA, 32 nt, Human
uguugggacaggagguacaaaggggaguggug

SEQ ID NO: 531570 - RNA, 32 nt, Human
uguugggagagggggagggaggggagacagag

SEQ ID NO: 531571 - RNA, 32 nt, Human
uguugggaggccaaggcuggcagaucacugga

SEQ ID NO: 531572 - RNA, 32 nt, Human
uguugggauaacaggcaugagccacugugccc

SEQ ID NO: 531573 - RNA, 32 nt, Human
uguugggauuacaggcaagagccaacacgccc

SEQ ID NO: 531574 - RNA, 32 nt, Human
uguugggauuacaggcaaugagccaccacgcc

SEQ ID NO: 531575 - RNA, 32 nt, Human
uguugggauuacaggcauaagcauugcgccau

SEQ ID NO: 531576 - RNA, 32 nt, Human
uguugggauuacaggcaugaaucaccaugccu

SEQ ID NO: 531577 - RNA, 21 nt, Human
uguugggauuacaggcaugag

SEQ ID NO: 531578 - RNA, 32 nt, Human
uguugggauuacaggcaugagccaccacgccu

SEQ ID NO: 531579 - RNA, 32 nt, Human
uguugggauuacaggcaugagccaccacuccu

SEQ ID NO: 531580 - RNA, 32 nt, Human
uguugggauuacaggcaugagccaccaugccc

SEQ ID NO: 531581 - RNA, 32 nt, Human
uguugggauuacaggcaugagccaccgcaccu

SEQ ID NO: 531582 - RNA, 32 nt, Human
uguugggauuacaggcaugagccaccugaaaa

SEQ ID NO: 531583 - RNA, 32 nt, Human
uguugggauuacaggcaugagccacugcaccc

SEQ ID NO: 531584 - RNA, 32 nt, Human
uguugggauuacaggcaugagccacugcgccc

SEQ ID NO: 531585 - RNA, 32 nt, Human
uguugggauuacaggcaugagccacugcgccu

SEQ ID NO: 531586 - RNA, 32 nt, Human
uguugggauuacaggcaugagccacugugccu

SEQ ID NO: 531587 - RNA, 32 nt, Human
uguugggauuacaggcaugagccacugugcuu

SEQ ID NO: 531588 - RNA, 32 nt, Human
uguugggauuacaggcaugagcuacuacauac

SEQ ID NO: 531589 - RNA, 32 nt, Human
uguugggauuacaggcgugagccaccucacca

SEQ ID NO: 531590 - RNA, 21 nt, Human
uguugggauuacaggugugag

SEQ ID NO: 531591 - RNA, 21 nt, Human
uguugggauuauaggcgugag

SEQ ID NO: 531592 - RNA, 32 nt, Human
uguugggcaaagcaacucuuuuucaaccacug

SEQ ID NO: 531593 - RNA, 32 nt, Human
uguugggcacuucgggccucagaaaacagcag

SEQ ID NO: 531594 - RNA, 22 nt, Human
uguugggcaggcagguaagggg

SEQ ID NO: 531595 - RNA, 32 nt, Human
uguugggcagucucacuguccuaagguauguc

SEQ ID NO: 531596 - RNA, 32 nt, Human
uguugggcccaucuccuuugcacuuugcucag

SEQ ID NO: 531597 - RNA, 32 nt, Human
uguugggccuauaguagcagguuagugaguac

SEQ ID NO: 531598 - RNA, 32 nt, Human
uguugggcgagagguguucucugugcugugaa

SEQ ID NO: 531599 - RNA, 32 nt, Human
uguugggcucaagcguuucucuugccucagcc

SEQ ID NO: 531600 - RNA, 32 nt, Human
uguugggcuguuaacugcugcaccucauugcc

SEQ ID NO: 531601 - RNA, 32 nt, Human
uguugggcuuugcagcucacacccaacagauc

SEQ ID NO: 531602 - RNA, 20 nt, Human
uguuggggacagugcgugau

SEQ ID NO: 531603 - RNA, 32 nt, Human
uguuggggagagaagaaaggggguucagaggc

SEQ ID NO: 531604 - RNA, 32 nt, Human
uguuggggagagaaggauggagauaggaugga

SEQ ID NO: 531605 - RNA, 32 nt, Human
uguuggggagagaggcagaggcagcuggagcg

SEQ ID NO: 531606 - RNA, 32 nt, Human
uguuggggccaggcacaguggcccaggccugu

SEQ ID NO: 531607 - RNA, 32 nt, Human
uguuggggccuccagccagggcccucuagggg

SEQ ID NO: 531608 - RNA, 32 nt, Human
uguuggggcugaggggaaggaggagaagcucc

SEQ ID NO: 531609 - RNA, 32 nt, Human
uguuggggcuguaggccuggggcagguucaga

SEQ ID NO: 531610 - RNA, 32 nt, Human
uguugggggaaaggaaagaauucacuagaaau

SEQ ID NO: 531611 - RNA, 32 nt, Human
uguugggggagacaggagagagaucccacggg

SEQ ID NO: 531612 - RNA, 32 nt, Human
uguugggggagcaagggccuucugcuggagac

SEQ ID NO: 531613 - RNA, 32 nt, Human
uguuggggguagaaaaguuuggauaucagauc

SEQ ID NO: 531614 - RNA, 32 nt, Human
uguuggggguagugggaggagaacggucagaa

SEQ ID NO: 531615 - RNA, 18 nt, Human
uguugggggugagggaaa

SEQ ID NO: 531616 - RNA, 32 nt, Human
uguuggggguugggggcagaaaaugcucccug

SEQ ID NO: 531617 - RNA, 32 nt, Human
uguuggggugacccucccacacccagccugga

SEQ ID NO: 531618 - RNA, 32 nt, Human
uguuggggugcagccaagcaggaggccaaggg

SEQ ID NO: 531619 - RNA, 32 nt, Human
uguugggguggcacaguggcccaaagagcagc

SEQ ID NO: 531620 - RNA, 32 nt, Human
uguugggguguuuuugcuuagaaagguccccu

SEQ ID NO: 531621 - RNA, 32 nt, Human
uguugggucuuggguugugugguuugguagcu

SEQ ID NO: 531622 - RNA, 32 nt, Human
uguugggucuuguaguucaugagugcaggagu

SEQ ID NO: 531623 - RNA, 32 nt, Human
uguugggugggagcacaggcaccgggcaccau

SEQ ID NO: 531624 - RNA, 32 nt, Human
uguuggguugucaaaacugggguggggaaaag

SEQ ID NO: 531625 - RNA, 24 nt, Human
uguuggguuuuagccaguuugcca

SEQ ID NO: 531626 - RNA, 24 nt, Human
uguuggguuuugagcaggcuguua

SEQ ID NO: 531627 - RNA, 32 nt, Human
uguugguaaagcacaugguucaaaucuagaag

SEQ ID NO: 531628 - RNA, 32 nt, Human
uguugguagcugggaccucaucuuccugaggg

SEQ ID NO: 531629 - RNA, 32 nt, Human
uguugguaggaaaguggcagggcugggggaga

SEQ ID NO: 531630 - RNA, 32 nt, Human
uguugguaggagguggggccaagaguggggua

SEQ ID NO: 531631 - RNA, 32 nt, Human
uguugguauuacaggcaugagccgcuacaccc

SEQ ID NO: 531632 - RNA, 32 nt, Human
uguuggucauuucucaguccuauuucucaguu

SEQ ID NO: 531633 - RNA, 32 nt, Human
uguugguccugucucugcucucacaguucuuu

SEQ ID NO: 531634 - RNA, 32 nt, Human
uguuggucucaaacuccugaccucagguaauc

SEQ ID NO: 531635 - RNA, 32 nt, Human
uguuggucucgaacuccugaccucaugaucug

SEQ ID NO: 531636 - RNA, 32 nt, Human
uguuggugaaguguugggggauggagggcggg

SEQ ID NO: 531637 - RNA, 32 nt, Human
uguuggugccaugccaguacagccugcagaau

SEQ ID NO: 531638 - RNA, 32 nt, Human
uguugguggaaugggaugugagaggacacgcg

SEQ ID NO: 531639 - RNA, 32 nt, Human
uguugguggcaaaauugccaacauaaguuaau

SEQ ID NO: 531640 - RNA, 32 nt, Human
uguugguggguggcagcacuuccagugggaag

SEQ ID NO: 531641 - RNA, 32 nt, Human
uguuggugucggcagggcugucagggcacaug

SEQ ID NO: 531642 - RNA, 32 nt, Human
uguugguguuuaauaauuuggagcucauaaaa

SEQ ID NO: 531643 - RNA, 32 nt, Human
uguugguuaauuccugccuuccucccuuuucc

SEQ ID NO: 531644 - RNA, 23 nt, Human
uguugguuacauuacaaaugcau

SEQ ID NO: 531645 - RNA, 32 nt, Human
uguugguucccugauuuuugucuugagcaggc

SEQ ID NO: 531646 - RNA, 32 nt, Human
uguugguuccuaucaccucuuguccucaguuu

SEQ ID NO: 531647 - RNA, 32 nt, Human
uguugguugacugcccuggccccuuugcacac

SEQ ID NO: 531648 - RNA, 32 nt, Human
uguugguugaucugauauguaaaguucagccu

SEQ ID NO: 531649 - RNA, 32 nt, Human
uguugguugugguuuuucuaucagggaaguca

SEQ ID NO: 531650 - RNA, 32 nt, Human
uguugguuuacaauacagcaagccugaugguu

SEQ ID NO: 531651 - RNA, 32 nt, Human
uguugguuucacugagagcugccuccuggucu

SEQ ID NO: 531652 - RNA, 32 nt, Human
uguugguuuucaucuucaagaaguugauucca

SEQ ID NO: 531653 - RNA, 32 nt, Human
uguuguaaaauggccuaaaaguucaaggcaug

SEQ ID NO: 531654 - RNA, 32 nt, Human
uguuguaaagaauccucguuaagucauuuugu

SEQ ID NO: 531655 - RNA, 32 nt, Human
uguuguaagaaagacugugcagaggagugugg

SEQ ID NO: 531656 - RNA, 32 nt, Human
uguuguaaguguuuacaacuggcaugugcuuu

SEQ ID NO: 531657 - RNA, 32 nt, Human
uguuguacaagaugucagcuuugcugaaacgc

SEQ ID NO: 531658 - RNA, 32 nt, Human
uguuguacagccauuggggauuacacgugcag

SEQ ID NO: 531659 - RNA, 32 nt, Human
uguuguacauaccuacaaguaccauuuuugug

SEQ ID NO: 531660 - RNA, 32 nt, Human
uguuguaccaccuuggugagucauaugccacu

SEQ ID NO: 531661 - RNA, 32 nt, Human
uguuguaccacugcacuccagccugggugaca

SEQ ID NO: 531662 - RNA, 31 nt, Human
uguuguaccucuuuugcuugccaaaguacag

SEQ ID NO: 531663 - RNA, 32 nt, Human
uguuguagauacaaucagcugcuuuguuaccu

SEQ ID NO: 531664 - RNA, 32 nt, Human
uguuguagcuaauaacaacaggcacgucaagg

SEQ ID NO: 531665 - RNA, 32 nt, Human
uguuguagcuuugucuuuuuauuuuucuuuuc

SEQ ID NO: 531666 - RNA, 32 nt, Human
uguuguauaaggacuguaagaucaggggcauc

SEQ ID NO: 531667 - RNA, 32 nt, Human
uguuguaucuguguguuuaucuauuccacauu

SEQ ID NO: 531668 - RNA, 32 nt, Human
uguugucaacaaaccaagcaucagggggaaga

SEQ ID NO: 531669 - RNA, 32 nt, Human
uguugucaacaggcaccuggccagagugaaaa

SEQ ID NO: 531670 - RNA, 32 nt, Human
uguugucacccagcuggcuaugaagugaauaa

SEQ ID NO: 531671 - RNA, 32 nt, Human
uguugucacccaggcuggagugcaguggugug

SEQ ID NO: 531672 - RNA, 32 nt, Human
uguugucauacugucugugcugauggcuuggc

SEQ ID NO: 531673 - RNA, 32 nt, Human
uguugucaucugaguugagcacuggucacauu

SEQ ID NO: 531674 - RNA, 32 nt, Human
uguugucauuauauuugacugugguucaacag

SEQ ID NO: 531675 - RNA, 32 nt, Human
uguuguccaaggcuggaguguaguagugcuau

SEQ ID NO: 531676 - RNA, 24 nt, Human
uguuguccaggcuagagugcagug

SEQ ID NO: 531677 - RNA, 24 nt, Human
uguuguccaggcuggagggcagug

SEQ ID NO: 531678 - RNA, 24 nt, Human
uguuguccaggcuggagugcaaug

SEQ ID NO: 531679 - RNA, 22 nt, Human
uguuguccaggcuggagugcag

SEQ ID NO: 531680 - RNA, 23 nt, Human
uguuguccaggcuggagugcagu

SEQ ID NO: 531681 - RNA, 24 nt, Human
uguuguccaggcuggagugcagug

SEQ ID NO: 531682 - RNA, 32 nt, Human
uguugucccagugcccugguucagugucuccu

SEQ ID NO: 531683 - RNA, 32 nt, Human
uguugucccuuacaugauggugcugcaagaaa

SEQ ID NO: 531684 - RNA, 32 nt, Human
uguugucccuugccugccuguaaggaauaaag

SEQ ID NO: 531685 - RNA, 32 nt, Human
uguugucccuuucuuuuuauuuuuaaggccuu

SEQ ID NO: 531686 - RNA, 32 nt, Human
uguuguccuaggauugcauguuaguaccccua

SEQ ID NO: 531687 - RNA, 32 nt, Human
uguugucgccuaggcuggagugcaaugaugcg

SEQ ID NO: 531688 - RNA, 32 nt, Human
uguugucgcucgcucagcgucucccucucggc

SEQ ID NO: 531689 - RNA, 32 nt, Human
uguugucguguuuacaguuugcauuuugaaug

SEQ ID NO: 531690 - RNA, 32 nt, Human
uguugucuaaaauguggacucaggagccagac

SEQ ID NO: 531691 - RNA, 32 nt, Human
uguugucuauggcccccagccccagccucugg

SEQ ID NO: 531692 - RNA, 32 nt, Human
uguugucucaacccucucccuaaaaugacuga

SEQ ID NO: 531693 - RNA, 32 nt, Human
uguugucucacugcauccaaugcuuuuccuuc

SEQ ID NO: 531694 - RNA, 32 nt, Human
uguugucucccaggcuggagugcaguggcgug

SEQ ID NO: 531695 - RNA, 23 nt, Human
uguugucucuguguuguacagug

SEQ ID NO: 531696 - RNA, 32 nt, Human
uguugucugcuuucuuucuccuucuacuaugc

SEQ ID NO: 531697 - RNA, 32 nt, Human
uguugucuggaagggcagguucagaugcagcc

SEQ ID NO: 531698 - RNA, 32 nt, Human
uguugucuuacuugauauuucuugcccuagua

SEQ ID NO: 531699 - RNA, 32 nt, Human
uguugucuucucauggugagcuuuucugugcc

SEQ ID NO: 531700 - RNA, 32 nt, Human
uguugucuugaacaagucacacccucucuuaa

SEQ ID NO: 531701 - RNA, 32 nt, Human
uguugucuuuuacuuuuguuuuuaaccugggg

SEQ ID NO: 531702 - RNA, 32 nt, Human
uguugucuuuuuauguggaaacugcuagacaa

SEQ ID NO: 531703 - RNA, 32 nt, Human
uguugugacugcugccauuuuuggaaacaucu

SEQ ID NO: 531704 - RNA, 32 nt, Human
uguugugcaaagugcaaggcugaacauugaau

SEQ ID NO: 531705 - RNA, 32 nt, Human
uguugugcagcuucuccaccuccugguagagg

SEQ ID NO: 531706 - RNA, 24 nt, Human
uguugugcaggcuggagugcagug

SEQ ID NO: 531707 - RNA, 24 nt, Human
uguugugcaggcuguagugcagug

SEQ ID NO: 531708 - RNA, 32 nt, Human
uguugugcauccucaaccuccaucccugcccu

SEQ ID NO: 531709 - RNA, 32 nt, Human
uguugugccccaggcacugucacauauuauuu

SEQ ID NO: 531710 - RNA, 32 nt, Human
uguugugcccuggaaucagccugguugagcuc

SEQ ID NO: 531711 - RNA, 32 nt, Human
uguugugccugggcaucgucuggauuuuccca

SEQ ID NO: 531712 - RNA, 32 nt, Human
uguugugcggcgccaugcaggucuccagccuc

SEQ ID NO: 531713 - RNA, 32 nt, Human
uguugugcuaugagccucuguaaucaaaugcu

SEQ ID NO: 531714 - RNA, 32 nt, Human
uguugugcucaagugauucucccaucucagcc

SEQ ID NO: 531715 - RNA, 32 nt, Human
uguuguggacaggaaacaggaggcuggaggag

SEQ ID NO: 531716 - RNA, 32 nt, Human
uguuguggauccugcgugucuagacccacgug

SEQ ID NO: 531717 - RNA, 32 nt, Human
uguuguggauuuuucacaagaagauuaauaaa

SEQ ID NO: 531718 - RNA, 32 nt, Human
uguuguggccuuccugaacugggaagucccug

SEQ ID NO: 531719 - RNA, 32 nt, Human
uguuguggcgggugccuguaaucucagcuacu

SEQ ID NO: 531720 - RNA, 32 nt, Human
uguugugggaaugggaccuagguaggagguga

SEQ ID NO: 531721 - RNA, 32 nt, Human
uguugugggcagcgucuuucucugccuuugcu

SEQ ID NO: 531722 - RNA, 32 nt, Human
uguuguggggguuugucuugugcacuguaggu

SEQ ID NO: 531723 - RNA, 32 nt, Human
uguugugggguagggggaugggggagggauag

SEQ ID NO: 531724 - RNA, 32 nt, Human
uguuguggggugugacagggagcucuugcagc

SEQ ID NO: 531725 - RNA, 32 nt, Human
uguugugggugucugugugugaggucacccuc

SEQ ID NO: 531726 - RNA, 32 nt, Human
uguuguggugcgcaccuguaauuccagcuacu

SEQ ID NO: 531727 - RNA, 32 nt, Human
uguuguggugggcgccuguaaucccagcugcu

SEQ ID NO: 531728 - RNA, 32 nt, Human
uguuguguauaucucugguagauauguguuau

SEQ ID NO: 531729 - RNA, 31 nt, Human
uguuguguccugucucccagcagagacuaca

SEQ ID NO: 531730 - RNA, 32 nt, Human
uguuguguccugucucccagcagagacuacaa

SEQ ID NO: 531731 - RNA, 32 nt, Human
uguugugucgagaagcaacacuuugugaucuc

SEQ ID NO: 531732 - RNA, 32 nt, Human
uguugugugccuguagucccagcuacuuagga

SEQ ID NO: 531733 - RNA, 32 nt, Human
uguugugugggugggagugagacuggguagaa

SEQ ID NO: 531734 - RNA, 32 nt, Human
uguugugugugaauauguguuacaccuaggau

SEQ ID NO: 531735 - RNA, 32 nt, Human
uguuguguugcacuccaggcaccuggccaaga

SEQ ID NO: 531736 - RNA, 32 nt, Human
uguuguuaaaaggcuaaugucauuuuaaaauu

SEQ ID NO: 531737 - RNA, 32 nt, Human
uguuguuauuuuuaaaguacaguaggguguga

SEQ ID NO: 531738 - RNA, 32 nt, Human
uguuguuauuuuuaguagagacgguguuucac

SEQ ID NO: 531739 - RNA, 27 nt, Human
uguuguucaagacuuugaagcauugaa

SEQ ID NO: 531740 - RNA, 32 nt, Human
uguuguucaauuaucuccucccccucuucucu

SEQ ID NO: 531741 - RNA, 32 nt, Human
uguuguucauuuucagcacuuacuucaaaaga

SEQ ID NO: 531742 - RNA, 21 nt, Human
uguuguuccccuucccucaca

SEQ ID NO: 531743 - RNA, 32 nt, Human
uguuguucccugcacugcucccugcacuguuc

SEQ ID NO: 531744 - RNA, 23 nt, Human
uguuguuccucugcucugucaca

SEQ ID NO: 531745 - RNA, 32 nt, Human
uguuguuccuggcuggacuugauguccagggc

SEQ ID NO: 531746 - RNA, 32 nt, Human
uguuguucucaggaacauaguugcaggugugu

SEQ ID NO: 531747 - RNA, 32 nt, Human
uguuguucugcacuuaaccuagagagagaaaa

SEQ ID NO: 531748 - RNA, 32 nt, Human
uguuguucuuacaucauugauucauguaagua

SEQ ID NO: 531749 - RNA, 24 nt, Human
uguuguucuucccuauacuucaca

SEQ ID NO: 531750 - RNA, 32 nt, Human
uguuguugaauacuucauucacaagggaaaua

SEQ ID NO: 531751 - RNA, 32 nt, Human
uguuguugaauccauagccaauacauuuacag

SEQ ID NO: 531752 - RNA, 32 nt, Human
uguuguugagacaaggucucgcuguugcccag

SEQ ID NO: 531753 - RNA, 32 nt, Human
uguuguugaguucucugggucagaccucugaa

SEQ ID NO: 531754 - RNA, 32 nt, Human
uguuguugcagaugucagcagcaacaacaaag

SEQ ID NO: 531755 - RNA, 32 nt, Human
uguuguugcccaggcuggagugcaauagcacg

SEQ ID NO: 531756 - RNA, 32 nt, Human
uguuguugcccaggcuggagugcaauggcacg

SEQ ID NO: 531757 - RNA, 32 nt, Human
uguuguugcccaggcuggagugcaauggcgcg

SEQ ID NO: 531758 - RNA, 32 nt, Human
uguuguugcccaggcuggagugcaauggcgua

SEQ ID NO: 531759 - RNA, 32 nt, Human
uguuguugcccaggcuggagugcaguggcgug

SEQ ID NO: 531760 - RNA, 32 nt, Human
uguuguugggaaacagggagugagugaaggga

SEQ ID NO: 531761 - RNA, 32 nt, Human
uguuguuuaaauucauuugaaaccagaagggg

SEQ ID NO: 531762 - RNA, 32 nt, Human
uguuguuuacaaacucagguacccgcagggcc

SEQ ID NO: 531763 - RNA, 32 nt, Human
uguuguuuacauuuugcugugacauuuaaaaa

SEQ ID NO: 531764 - RNA, 32 nt, Human
uguuguuucucuacuuuguuuuguuuuaggcu

SEQ ID NO: 531765 - RNA, 32 nt, Human
uguuguuugcccagccugggcugcagaaagca

SEQ ID NO: 531766 - RNA, 32 nt, Human
uguuguuugucuuugaugucaugguccccucu

SEQ ID NO: 531767 - RNA, 32 nt, Human
uguuguuuuacuauuuguuugacauaucagua

SEQ ID NO: 531768 - RNA, 24 nt, Human
uguuguuuuauuuaaagcauugaa

SEQ ID NO: 531769 - RNA, 24 nt, Human
uguuguuuuauuuagaaacaugaa

SEQ ID NO: 531770 - RNA, 32 nt, Human
uguuguuuugagacagggucucacuuugucac

SEQ ID NO: 531771 - RNA, 32 nt, Human
uguuguuuugagacagggucuugcccuguugc

SEQ ID NO: 531772 - RNA, 32 nt, Human
uguuguuuugagauggagucucgcucugucac

SEQ ID NO: 531773 - RNA, 32 nt, Human
uguuguuuugagauggaguuucgcucuuguug

SEQ ID NO: 531774 - RNA, 32 nt, Human
uguuguuuugagauggaguuuugcucuugcac

SEQ ID NO: 531775 - RNA, 32 nt, Human
uguuguuuuguagcaaccauuuguaaaacauu

SEQ ID NO: 531776 - RNA, 32 nt, Human
uguuguuuuuauuaaucuuuugucuuaaaaua

SEQ ID NO: 531777 - RNA, 32 nt, Human
uguuuaaaacacauuugaauuuauuucucagc

SEQ ID NO: 531778 - RNA, 32 nt, Human
uguuuaaagaagcccagggagggauagagcuc

SEQ ID NO: 531779 - RNA, 32 nt, Human
uguuuaaagauggaugaaaggccaggcauggu

SEQ ID NO: 531780 - RNA, 32 nt, Human
uguuuaaaguaacuaccaccuaacccaacaga

SEQ ID NO: 531781 - RNA, 32 nt, Human
uguuuaaagugucaccccucacugugacugau

SEQ ID NO: 531782 - RNA, 32 nt, Human
uguuuaaaucagcuguuucauguauuagccuu

SEQ ID NO: 531783 - RNA, 32 nt, Human
uguuuaaauggaaaggagaaugacagcaaagc

SEQ ID NO: 531784 - RNA, 32 nt, Human
uguuuaaauuacagauaacuucaagaguuuuc

SEQ ID NO: 531785 - RNA, 32 nt, Human
uguuuaacacggggaaaccccgucucuacuaa

SEQ ID NO: 531786 - RNA, 32 nt, Human
uguuuaacacgguuacugacuuagaugaugua

SEQ ID NO: 531787 - RNA, 32 nt, Human
uguuuaacaucagggugaccacauuaagccca

SEQ ID NO: 531788 - RNA, 32 nt, Human
uguuuaacauggcugagcccucucugaggcca

SEQ ID NO: 531789 - RNA, 32 nt, Human
uguuuaaccacugcuaucacgcuauccuggga

SEQ ID NO: 531790 - RNA, 20 nt, Human
uguuuaaccuguugcuuccu

SEQ ID NO: 531791 - RNA, 32 nt, Human
uguuuaacucuuuggugucugugcucaaaaga

SEQ ID NO: 531792 - RNA, 32 nt, Human
uguuuaacuguuuguuaucauaguuggucaau

SEQ ID NO: 531793 - RNA, 32 nt, Human
uguuuaagagagagugguuccugcuguuuauu

SEQ ID NO: 531794 - RNA, 32 nt, Human
uguuuaagaggucaggaggccugcugaucuuu

SEQ ID NO: 531795 - RNA, 32 nt, Human
uguuuaagcuuuguuccuuuuuauggcugagc

SEQ ID NO: 531796 - RNA, 32 nt, Human
uguuuaaggagcaagacaggaaggagaaacca

SEQ ID NO: 531797 - RNA, 32 nt, Human
uguuuaaggagguggggcgcguuucaguggcu

SEQ ID NO: 531798 - RNA, 32 nt, Human
uguuuaagggcugcauuccaugaugcuaucag

SEQ ID NO: 531799 - RNA, 32 nt, Human
uguuuaagugaucaggaugccguugguggcau

SEQ ID NO: 531800 - RNA, 32 nt, Human
uguuuaauaacuucuaauggccaucuguaaac

SEQ ID NO: 531801 - RNA, 32 nt, Human
uguuuaauguacuuggaguuuccuuguaguag

SEQ ID NO: 531802 - RNA, 32 nt, Human
uguuuaauuaaccccauguccacuuugccucu

SEQ ID NO: 531803 - RNA, 32 nt, Human
uguuuaauuuucacaaauuugugaauuuucca

SEQ ID NO: 531804 - RNA, 32 nt, Human
uguuuacacaccacuuuccugccuccucucug

SEQ ID NO: 531805 - RNA, 32 nt, Human
uguuuacagauuauugguuacacuucaauuua

SEQ ID NO: 531806 - RNA, 32 nt, Human
uguuuacagcauauuuaagucuugugaaacug

SEQ ID NO: 531807 - RNA, 32 nt, Human
uguuuacaggcaagcccugcuccugggagggc

SEQ ID NO: 531808 - RNA, 32 nt, Human
uguuuacagucacccuuggguccuaaauuaag

SEQ ID NO: 531809 - RNA, 32 nt, Human
uguuuacauagagauucaucacugcagauuac

SEQ ID NO: 531810 - RNA, 32 nt, Human
uguuuacauauauaccuauauguaaguguuuu

SEQ ID NO: 531811 - RNA, 32 nt, Human
uguuuacauaugcauagcgcugcacucagucg

SEQ ID NO: 531812 - RNA, 32 nt, Human
uguuuacauggcgcccugccuccuggaggacc

SEQ ID NO: 531813 - RNA, 32 nt, Human
uguuuacauuuugcugugacauuuaaaaauau

SEQ ID NO: 531814 - RNA, 32 nt, Human
uguuuaccaacuucucuuucuccuccuuuccc

SEQ ID NO: 531815 - RNA, 32 nt, Human
uguuuaccaagcuaugugacuucucccaaagg

SEQ ID NO: 531816 - RNA, 32 nt, Human
uguuuaccaagguccugcugugcacuuagaau

SEQ ID NO: 531817 - RNA, 32 nt, Human
uguuuaccaguauuaaauucucagccacucaa

SEQ ID NO: 531818 - RNA, 32 nt, Human
uguuuaccaugucagcuucagccugggggcuc

SEQ ID NO: 531819 - RNA, 32 nt, Human
uguuuaccuaacccagcccuuaauuagggcuu

SEQ ID NO: 531820 - RNA, 32 nt, Human
uguuuaccuauguaacaaaccugcacauccug

SEQ ID NO: 531821 - RNA, 32 nt, Human
uguuuaccuauguaacaaaccugcacguucug

SEQ ID NO: 531822 - RNA, 32 nt, Human
uguuuaccuauguaacaaaccugcauauccug

SEQ ID NO: 531823 - RNA, 32 nt, Human
uguuuaccuauguagaaaccuucauauguauc

SEQ ID NO: 531824 - RNA, 32 nt, Human
uguuuaccuuggucuuguuuuaagucuuaaaa

SEQ ID NO: 531825 - RNA, 32 nt, Human
uguuuaccuuucucucucuaagguuuacaaua

SEQ ID NO: 531826 - RNA, 32 nt, Human
uguuuacuagcuugguggaugagggaguggug

SEQ ID NO: 531827 - RNA, 32 nt, Human
uguuuacuagugaaaugagaaaagcaaagcua

SEQ ID NO: 531828 - RNA, 32 nt, Human
uguuuacuaucuauugcuguaaaguuuuguau

SEQ ID NO: 531829 - RNA, 32 nt, Human
uguuuacuccagccuauggauccgugaccaau

SEQ ID NO: 531830 - RNA, 32 nt, Human
uguuuacugaacaccacucugugcuaagcccu

SEQ ID NO: 531831 - RNA, 32 nt, Human
uguuuacuuggucccagcuuuugagagauaaa

SEQ ID NO: 531832 - RNA, 32 nt, Human
uguuuagaaauguauuucuccacagggcugac

SEQ ID NO: 531833 - RNA, 32 nt, Human
uguuuagaacuacgacuugcucugucauucca

SEQ ID NO: 531834 - RNA, 32 nt, Human
uguuuagaaguaaccacagaaaagcaaaguca

SEQ ID NO: 531835 - RNA, 32 nt, Human
uguuuagaaguaggaagucacugugagcaaug

SEQ ID NO: 531836 - RNA, 32 nt, Human
uguuuagaauacugguuuucuauuuacgcaug

SEQ ID NO: 531837 - RNA, 32 nt, Human
uguuuagacagagagguaaggccugaaaaagu

SEQ ID NO: 531838 - RNA, 32 nt, Human
uguuuagagaaggcuucuccucugagcuggga

SEQ ID NO: 531839 - RNA, 32 nt, Human
uguuuagagccaggaggaaggcggaagguagg

SEQ ID NO: 531840 - RNA, 32 nt, Human
uguuuagagccugauauucuuccuccaagaau

SEQ ID NO: 531841 - RNA, 32 nt, Human
uguuuagaggcucugcccugagguucugcucc

SEQ ID NO: 531842 - RNA, 32 nt, Human
uguuuagauccagaaggagaguuuuaaucauu

SEQ ID NO: 531843 - RNA, 32 nt, Human
uguuuagaugaucuguccauuguugagauagg

SEQ ID NO: 531844 - RNA, 32 nt, Human
uguuuagcagcaucugucuccuccgcugacua

SEQ ID NO: 531845 - RNA, 32 nt, Human
uguuuagcugaguuuucuaauuuucuggaugu

SEQ ID NO: 531846 - RNA, 32 nt, Human
uguuuagcuggcucgaugauguuaacaguauu

SEQ ID NO: 531847 - RNA, 32 nt, Human
uguuuagcuuuuccuaguauugugagguuuca

SEQ ID NO: 531848 - RNA, 32 nt, Human
uguuuaggaagaaacucacucucuuuugccag

SEQ ID NO: 531849 - RNA, 32 nt, Human
uguuuaggaguuagggugaaagagaaaauguu

SEQ ID NO: 531850 - RNA, 32 nt, Human
uguuuaggcuuaguaaaccaguucccaaacac

SEQ ID NO: 531851 - RNA, 32 nt, Human
uguuuagggcccugauuugcugggcaguuuuu

SEQ ID NO: 531852 - RNA, 32 nt, Human
uguuuaggucccaauaaggaaggucugucccu

SEQ ID NO: 531853 - RNA, 32 nt, Human
uguuuaggugaucucaaauuaggaaaugcauu

SEQ ID NO: 531854 - RNA, 32 nt, Human
uguuuagguugaggacauacauucaaacuaau

SEQ ID NO: 531855 - RNA, 32 nt, Human
uguuuaguauauucagcuguaucuguagaaac

SEQ ID NO: 531856 - RNA, 32 nt, Human
uguuuagucauguguuuucaucuaagaaauua

SEQ ID NO: 531857 - RNA, 32 nt, Human
uguuuaguccacuugggucaucagcucugcca

SEQ ID NO: 531858 - RNA, 32 nt, Human
uguuuagucccagcuacacagcagggaggcug

SEQ ID NO: 531859 - RNA, 32 nt, Human
uguuuagucgcuuucaggguucuugagccccu

SEQ ID NO: 531860 - RNA, 32 nt, Human
uguuuaguguauuaauuaccaguggauuggua

SEQ ID NO: 531861 - RNA, 32 nt, Human
uguuuaguuccccacuuuaaugaugcuaaaau

SEQ ID NO: 531862 - RNA, 32 nt, Human
uguuuaguuuuagguuuacaacagagaggaau

SEQ ID NO: 531863 - RNA, 32 nt, Human
uguuuauaaaaauugaguggagauagauagac

SEQ ID NO: 531864 - RNA, 32 nt, Human
uguuuauaaaggccaaaugauagcgggggcua

SEQ ID NO: 531865 - RNA, 32 nt, Human
uguuuauaaugucugggagagaggauaggaug

SEQ ID NO: 531866 - RNA, 21 nt, Human
uguuuauacaauuuaauuuaa

SEQ ID NO: 531867 - RNA, 32 nt, Human
uguuuauaggagaaagcaaaauacaucagcuu

SEQ ID NO: 531868 - RNA, 32 nt, Human
uguuuaucaagcaaugcucagcuugaagaaua

SEQ ID NO: 531869 - RNA, 32 nt, Human
uguuuaucagaaagggcagaaguaggggaaga

SEQ ID NO: 531870 - RNA, 32 nt, Human
uguuuauccuacagcuuccugcaagcuccagu

SEQ ID NO: 531871 - RNA, 32 nt, Human
uguuuaucucauuuggcuaauagauggaaauc

SEQ ID NO: 531872 - RNA, 32 nt, Human
uguuuaucucccacuuacgagaacaugugguu

SEQ ID NO: 531873 - RNA, 32 nt, Human
uguuuaugacaguuugucauuuggcggguugg

SEQ ID NO: 531874 - RNA, 32 nt, Human
uguuuaugacuuauuugcucagaagaggcacg

SEQ ID NO: 531875 - RNA, 30 nt, Human
uguuuaugagccuggaagccacgaaguggu

SEQ ID NO: 531876 - RNA, 32 nt, Human
uguuuaugccuccauugccccaguucuuaucu

SEQ ID NO: 531877 - RNA, 32 nt, Human
uguuuaugcuaaaaauaacaccaaaauguggu

SEQ ID NO: 531878 - RNA, 32 nt, Human
uguuuauggaaauaccaggaccaguuuauguu

SEQ ID NO: 531879 - RNA, 31 nt, Human
uguuuauggacaauguucagcugacauaagc

SEQ ID NO: 531880 - RNA, 32 nt, Human
uguuuauggccucccuuaaggcauuuuacaaa

SEQ ID NO: 531881 - RNA, 32 nt, Human
uguuuauguaagagcaccuuccucacuuccau

SEQ ID NO: 531882 - RNA, 32 nt, Human
uguuuauuaagccagggauugugggacuuccc

SEQ ID NO: 531883 - RNA, 32 nt, Human
uguuuauuaguucuguauacaguacaggaucu

SEQ ID NO: 531884 - RNA, 32 nt, Human
uguuuauuccauccuuguuugaugaucgacca

SEQ ID NO: 531885 - RNA, 32 nt, Human
uguuuauuccuuggcuugccucccuccuuccu

SEQ ID NO: 531886 - RNA, 32 nt, Human
uguuuauugagcacuuacuuggaccaagcacu

SEQ ID NO: 531887 - RNA, 32 nt, Human
uguuuauugaggaaaaggaaugggaggcaaau

SEQ ID NO: 531888 - RNA, 32 nt, Human
uguuuauuugcuccuucucuucaugccugugg

SEQ ID NO: 531889 - RNA, 32 nt, Human
uguuuauuugggaccagaacaugguccaguuu

SEQ ID NO: 531890 - RNA, 32 nt, Human
uguuuauuuuaccucuauucuuuagguugaaa

SEQ ID NO: 531891 - RNA, 32 nt, Human
uguuuauuuucuucccuucccuucccuucccu

SEQ ID NO: 531892 - RNA, 32 nt, Human
uguuucaaacaugcccauuacuaacggcaaaa

SEQ ID NO: 531893 - RNA, 23 nt, Human
uguuucaaaguugaaacuacugu

SEQ ID NO: 531894 - RNA, 22 nt, Human
uguuucaacuugaagacaccgu

SEQ ID NO: 531895 - RNA, 32 nt, Human
uguuucaagagucauguuuccccagaugugau

SEQ ID NO: 531896 - RNA, 32 nt, Human
uguuucacaagacagauucuguccuugucacc

SEQ ID NO: 531897 - RNA, 32 nt, Human
uguuucacaccaaaagccuguguguuccucca

SEQ ID NO: 531898 - RNA, 32 nt, Human
uguuucacacucauuccucccauccaguguuu

SEQ ID NO: 531899 - RNA, 32 nt, Human
uguuucacauaaaaauacuucugacauaaagu

SEQ ID NO: 531900 - RNA, 32 nt, Human
uguuucaccauguuagucaggcuggucucgaa

SEQ ID NO: 531901 - RNA, 32 nt, Human
uguuucaccauguuggccaggcuggucucaaa

SEQ ID NO: 531902 - RNA, 32 nt, Human
uguuucaccauguuggccaggcuggucuccau

SEQ ID NO: 531903 - RNA, 32 nt, Human
uguuucaccauguuggucaggcuggucaugaa

SEQ ID NO: 531904 - RNA, 32 nt, Human
uguuucaccauguuggucaggcuggucucgaa

SEQ ID NO: 531905 - RNA, 32 nt, Human
uguuucaccauguuggucaggcuggucuugaa

SEQ ID NO: 531906 - RNA, 32 nt, Human
uguuucacccauauugcugguccuguuuuuca

SEQ ID NO: 531907 - RNA, 32 nt, Human
uguuucaccuuuccucagacuauuuuccagcc

SEQ ID NO: 531908 - RNA, 32 nt, Human
uguuucacuacauucuuccucccacugccagg

SEQ ID NO: 531909 - RNA, 32 nt, Human
uguuucagacuuuuguuugugugcuugcguug

SEQ ID NO: 531910 - RNA, 32 nt, Human
uguuucagaggugauuacaggccuggguuuga

SEQ ID NO: 531911 - RNA, 32 nt, Human
uguuucagauacauaguuuguaccuguauuuu

SEQ ID NO: 531912 - RNA, 22 nt, Human
uguuucagauucugaugaugaa

SEQ ID NO: 531913 - RNA, 32 nt, Human
uguuucagcauccauucccccuucuuuuagga

SEQ ID NO: 531914 - RNA, 32 nt, Human
uguuucagccucccgaguagcuggaauugcag

SEQ ID NO: 531915 - RNA, 32 nt, Human
uguuucagccuccugaguagcugggauuacag

SEQ ID NO: 531916 - RNA, 32 nt, Human
uguuucagccucugccuuuccacagcuccucc

SEQ ID NO: 531917 - RNA, 32 nt, Human
uguuucaggaagaagagagcagguagaaaggg

SEQ ID NO: 531918 - RNA, 32 nt, Human
uguuucaggaaggaaugaaagagaguucuuuc

SEQ ID NO: 531919 - RNA, 32 nt, Human
uguuucaggcaugauacuaggcaauuuauaua

SEQ ID NO: 531920 - RNA, 32 nt, Human
uguuucaggggugacucagaagaaaaagaagc

SEQ ID NO: 531921 - RNA, 31 nt, Human
uguuucagguauuucuuuaccccucuggauu

SEQ ID NO: 531922 - RNA, 32 nt, Human
uguuucagucagugacagaccucauauauggc

SEQ ID NO: 531923 - RNA, 32 nt, Human
uguuucaguccagugcacaucagcauugcuga

SEQ ID NO: 531924 - RNA, 32 nt, Human
uguuucaguucugugucaugguuggaagacag

SEQ ID NO: 531925 - RNA, 32 nt, Human
uguuucauaagaaggaaggcaggugaauaugu

SEQ ID NO: 531926 - RNA, 32 nt, Human
uguuucauaagaauucuguugauggaaauaca

SEQ ID NO: 531927 - RNA, 32 nt, Human
uguuucauaauguugugaaacuccacuugaag

SEQ ID NO: 531928 - RNA, 32 nt, Human
uguuucaucucccauucaucucccuccuccca

SEQ ID NO: 531929 - RNA, 32 nt, Human
uguuucaucucuaugacccuucuguuaccaca

SEQ ID NO: 531930 - RNA, 32 nt, Human
uguuucaucuguccccuuuuagcuccaccuga

SEQ ID NO: 531931 - RNA, 32 nt, Human
uguuucaucuucuucuuuacuuuuagcuucua

SEQ ID NO: 531932 - RNA, 32 nt, Human
uguuuccaacuugaaaccauuuugucacaucu

SEQ ID NO: 531933 - RNA, 32 nt, Human
uguuuccaauugccuccucuccggcuguggca

SEQ ID NO: 531934 - RNA, 32 nt, Human
uguuuccacagccugcaaguucaguccaggau

SEQ ID NO: 531935 - RNA, 32 nt, Human
uguuuccaccuccaugcuuccaagaaggagga

SEQ ID NO: 531936 - RNA, 32 nt, Human
uguuuccacuggcuuuccauccccauggggca

SEQ ID NO: 531937 - RNA, 32 nt, Human
uguuuccagaugaccagauuguuuuucugaaa

SEQ ID NO: 531938 - RNA, 32 nt, Human
uguuucccagccuguaccuuggaagccgaagg

SEQ ID NO: 531939 - RNA, 32 nt, Human
uguuucccaggaaaucaaagauguaaaugauu

SEQ ID NO: 531940 - RNA, 24 nt, Human
uguuucccaggcugaagugcagug

SEQ ID NO: 531941 - RNA, 24 nt, Human
uguuucccaggcuggagugcaaug

SEQ ID NO: 531942 - RNA, 24 nt, Human
uguuucccaggcuggagugcagug

SEQ ID NO: 531943 - RNA, 24 nt, Human
uguuucccaggcuggaguguagug

SEQ ID NO: 531944 - RNA, 32 nt, Human
uguuuccccucagaacacccuguaccauccau

SEQ ID NO: 531945 - RNA, 32 nt, Human
uguuuccccugccacuccagcccccuugagcu

SEQ ID NO: 531946 - RNA, 32 nt, Human
uguuucccuacggagagcacuuggagauggca

SEQ ID NO: 531947 - RNA, 32 nt, Human
uguuucccucaagacauaaaacaaauauaaac

SEQ ID NO: 531948 - RNA, 32 nt, Human
uguuucccucaaggaccuuucugccuggaagu

SEQ ID NO: 531949 - RNA, 32 nt, Human
uguuucccuccaggaaaccaucccugcucacc

SEQ ID NO: 531950 - RNA, 32 nt, Human
uguuucccuccccacuacuccuucuccuucua

SEQ ID NO: 531951 - RNA, 32 nt, Human
uguuucccuugcaauauguuaacucuguguag

SEQ ID NO: 531952 - RNA, 32 nt, Human
uguuucccuugguggauuuuuguguuuuguaa

SEQ ID NO: 531953 - RNA, 32 nt, Human
uguuuccgccguccugcuuccugccgaggcug

SEQ ID NO: 531954 - RNA, 32 nt, Human
uguuuccgcgggcagagauuuugaacacccaa

SEQ ID NO: 531955 - RNA, 32 nt, Human
uguuuccgucugcucaccugccacagagccca

SEQ ID NO: 531956 - RNA, 32 nt, Human
uguuuccuauuaaaauacagacauuucuaccc

SEQ ID NO: 531957 - RNA, 32 nt, Human
uguuuccuccuccaaaaugcuccugcuccucu

SEQ ID NO: 531958 - RNA, 32 nt, Human
uguuuccuccucccccgccucuuccaguucaa

SEQ ID NO: 531959 - RNA, 32 nt, Human
uguuuccucuacuccuggcucagaaacagcca

SEQ ID NO: 531960 - RNA, 32 nt, Human
uguuuccugaauucuugacauuuaucuuugcu

SEQ ID NO: 531961 - RNA, 32 nt, Human
uguuuccugcagcauguauuuccauggcccac

SEQ ID NO: 531962 - RNA, 32 nt, Human
uguuuccugccugucagccucuugccuccuaa

SEQ ID NO: 531963 - RNA, 32 nt, Human
uguuuccugggccucugcucagaggcagguca

SEQ ID NO: 531964 - RNA, 32 nt, Human
uguuuccugggugcccuggcuccuugcagcag

SEQ ID NO: 531965 - RNA, 32 nt, Human
uguuuccuguaaccaggauacagucugguugg

SEQ ID NO: 531966 - RNA, 32 nt, Human
uguuuccuguggccaggcacagagccaggugc

SEQ ID NO: 531967 - RNA, 19 nt, Human
uguuuccuuccucuacaua

SEQ ID NO: 531968 - RNA, 32 nt, Human
uguuuccuucugucaugcuuuccacuucuucc

SEQ ID NO: 531969 - RNA, 32 nt, Human
uguuuccuuggcccugcagcaggaugaagcuc

SEQ ID NO: 531970 - RNA, 32 nt, Human
uguuuccuuuucuccccucucuggguugacug

SEQ ID NO: 531971 - RNA, 18 nt, Human
uguuuccuuuugggcuca

SEQ ID NO: 531972 - RNA, 32 nt, Human
uguuucgaggugccucaacauggagccuugcc

SEQ ID NO: 531973 - RNA, 32 nt, Human
uguuucgccacugcacaccagccugggugaca

SEQ ID NO: 531974 - RNA, 32 nt, Human
uguuucgcgggggagugagggggaagaacacg

SEQ ID NO: 531975 - RNA, 32 nt, Human
uguuucguagacugagaacauggagggacugg

SEQ ID NO: 531976 - RNA, 32 nt, Human
uguuucuaaagaaacgucaguauuucagucug

SEQ ID NO: 531977 - RNA, 32 nt, Human
uguuucuaccagaugagcaggaagagauucca

SEQ ID NO: 531978 - RNA, 24 nt, Human
uguuucuacuaaaaauaaaaaaua

SEQ ID NO: 531979 - RNA, 32 nt, Human
uguuucuacuaaaaauacaaaaaugagcuggg

SEQ ID NO: 531980 - RNA, 32 nt, Human
uguuucuacuaaaaauacaaaaauuagccgag

SEQ ID NO: 531981 - RNA, 32 nt, Human
uguuucuacuaaaaauacaaaaauuagcuagg

SEQ ID NO: 531982 - RNA, 32 nt, Human
uguuucuacuaaaaauacaaaaauuagcugga

SEQ ID NO: 531983 - RNA, 32 nt, Human
uguuucuacuaaaaauacaaaaauuagcuggg

SEQ ID NO: 531984 - RNA, 32 nt, Human
uguuucuacuaaaauauacaaaaauuagccag

SEQ ID NO: 531985 - RNA, 32 nt, Human
uguuucuacugaaaauacaaaaauuagccagg

SEQ ID NO: 531986 - RNA, 32 nt, Human
uguuucuagguaguaggaaccuuacaaauaca

SEQ ID NO: 531987 - RNA, 23 nt, Human
uguuucuauuuuauggaugagca

SEQ ID NO: 531988 - RNA, 32 nt, Human
uguuucucagaaaagguuaccuuuguauuaau

SEQ ID NO: 531989 - RNA, 32 nt, Human
uguuucucaguguuccuuaacagccugccuuu

SEQ ID NO: 531990 - RNA, 32 nt, Human
uguuucucaguuauccagggaagaacagugua

SEQ ID NO: 531991 - RNA, 32 nt, Human
uguuucuccagccgugcggugcagccucaugc

SEQ ID NO: 531992 - RNA, 32 nt, Human
uguuucuccaucuaccaccauccaccagucua

SEQ ID NO: 531993 - RNA, 32 nt, Human
uguuucuccuaccugggagauuucagcaagga

SEQ ID NO: 531994 - RNA, 32 nt, Human
uguuucuccuccugaaauguuuaugaauugcu

SEQ ID NO: 531995 - RNA, 32 nt, Human
uguuucucuaaaggucucccaggccuucccag

SEQ ID NO: 531996 - RNA, 21 nt, Human
uguuucucuaguguuauggca

SEQ ID NO: 531997 - RNA, 32 nt, Human
uguuucucuccuccgcuuaaccaagcuguugu

SEQ ID NO: 531998 - RNA, 32 nt, Human
uguuucucugggagguaggacggcugcuuccu

SEQ ID NO: 531999 - RNA, 32 nt, Human
uguuucugaaaagcaacugaggugugacuguu

SEQ ID NO: 532000 - RNA, 32 nt, Human
uguuucugaaauccaacaugcuuuagacuuga

SEQ ID NO: 532001 - RNA, 32 nt, Human
uguuucugaacugucuucuuuugcaagacuga

SEQ ID NO: 532002 - RNA, 32 nt, Human
uguuucugaacuuuacuuacuaauuuucagug

SEQ ID NO: 532003 - RNA, 32 nt, Human
uguuucugacagacugauacugaugccaaaca

SEQ ID NO: 532004 - RNA, 32 nt, Human
uguuucugacccuuucugucggaguggucucu

SEQ ID NO: 532005 - RNA, 32 nt, Human
uguuucugcagaggcagcaggagccagcccgg

SEQ ID NO: 532006 - RNA, 32 nt, Human
uguuucugccaaaaauacaaaaauuagcuggg

SEQ ID NO: 532007 - RNA, 32 nt, Human
uguuucugccaagggauugacauggagggagc

SEQ ID NO: 532008 - RNA, 21 nt, Human
uguuucugccacccuguaaca

SEQ ID NO: 532009 - RNA, 32 nt, Human
uguuucugcccucuguguuuccuguugucaaa

SEQ ID NO: 532010 - RNA, 32 nt, Human
uguuucugcuuugccaugacccuggucauccu

SEQ ID NO: 532011 - RNA, 22 nt, Human
uguuucuggaaacugcuugcca

SEQ ID NO: 532012 - RNA, 20 nt, Human
uguuucuggaaggcaucugc

SEQ ID NO: 532013 - RNA, 32 nt, Human
uguuucuggaguuuacaugaugaccaagguac

SEQ ID NO: 532014 - RNA, 32 nt, Human
uguuucuggauugaagccagaaucaacauugu

SEQ ID NO: 532015 - RNA, 32 nt, Human
uguuucuggcuccacugccugccagugaagga

SEQ ID NO: 532016 - RNA, 32 nt, Human
uguuucugggagaggaaaccugaagcccagag

SEQ ID NO: 532017 - RNA, 32 nt, Human
uguuucuggggcucugaaaaucugugggaacu

SEQ ID NO: 532018 - RNA, 32 nt, Human
uguuucuguagucccagcuacucgggaggcug

SEQ ID NO: 532019 - RNA, 32 nt, Human
uguuucugugaacaugaaguucugcgguagug

SEQ ID NO: 532020 - RNA, 32 nt, Human
uguuucugugagagugacagagcugugcccgu

SEQ ID NO: 532021 - RNA, 32 nt, Human
uguuucuguggcagacauugcuaaucaauuac

SEQ ID NO: 532022 - RNA, 32 nt, Human
uguuucuguguauccuauugcuggugacucug

SEQ ID NO: 532023 - RNA, 32 nt, Human
uguuucugugucauuaaccaucuuuaaucaau

SEQ ID NO: 532024 - RNA, 32 nt, Human
uguuucuguguguuguccagcguauucauuca

SEQ ID NO: 532025 - RNA, 32 nt, Human
uguuucuguuauuguuuugaagaagguagcuc

SEQ ID NO: 532026 - RNA, 23 nt, Human
uguuucuguuuuaucucauggua

SEQ ID NO: 532027 - RNA, 32 nt, Human
uguuucuuaccuuagccugaaccuucucaggc

SEQ ID NO: 532028 - RNA, 32 nt, Human
uguuucuuagagaaaugccucggaugccgccg

SEQ ID NO: 532029 - RNA, 32 nt, Human
uguuucuuagcucugaccuguacagugaggua

SEQ ID NO: 532030 - RNA, 32 nt, Human
uguuucuuaucaccagcccaucagcccacuga

SEQ ID NO: 532031 - RNA, 32 nt, Human
uguuucuucaacaaaaacugauagagauuuuu

SEQ ID NO: 532032 - RNA, 32 nt, Human
uguuucuucacucaacucagguggcauuuggg

SEQ ID NO: 532033 - RNA, 32 nt, Human
uguuucuuccaauucucucuucugcuugacca

SEQ ID NO: 532034 - RNA, 32 nt, Human
uguuucuucuccuccuuucucucccucuuucc

SEQ ID NO: 532035 - RNA, 32 nt, Human
uguuucuugccucugugccuucaaccugcugc

SEQ ID NO: 532036 - RNA, 32 nt, Human
uguuucuugccuggaguuguagacgggauuuc

SEQ ID NO: 532037 - RNA, 32 nt, Human
uguuucuuggauaggggccagugcagugccau

SEQ ID NO: 532038 - RNA, 32 nt, Human
uguuucuuguucugccugacuggccgcuggcu

SEQ ID NO: 532039 - RNA, 32 nt, Human
uguuucuuuacagagguaccugagggaggaga

SEQ ID NO: 532040 - RNA, 32 nt, Human
uguuucuuucauuccuuguucuagagcuaacc

SEQ ID NO: 532041 - RNA, 32 nt, Human
uguuucuuucuuucuuucacaugacugcccuu

SEQ ID NO: 532042 - RNA, 32 nt, Human
uguuucuuugagauggagucuugcucugucac

SEQ ID NO: 532043 - RNA, 32 nt, Human
uguuucuuuguuccuuucguuugcuuucuuau

SEQ ID NO: 532044 - RNA, 32 nt, Human
uguuugaaagauguucccuuccuucacuguag

SEQ ID NO: 532045 - RNA, 32 nt, Human
uguuugaacccaggagaguggaagagagauug

SEQ ID NO: 532046 - RNA, 32 nt, Human
uguuugaacucucuuauauucucccacuagcc

SEQ ID NO: 532047 - RNA, 32 nt, Human
uguuugaagaggagcagagaggcuggcacuag

SEQ ID NO: 532048 - RNA, 32 nt, Human
uguuugaagcaguuacuaaacucgucaugcug

SEQ ID NO: 532049 - RNA, 32 nt, Human
uguuugaauaauaaaguauggaggagaaggag

SEQ ID NO: 532050 - RNA, 32 nt, Human
uguuugaaugaguuuauauggaaaaaugaacu

SEQ ID NO: 532051 - RNA, 32 nt, Human
uguuugacacuuauagauugaaauuuccuaau

SEQ ID NO: 532052 - RNA, 21 nt, Human
uguuugacauuagccauuuaa

SEQ ID NO: 532053 - RNA, 32 nt, Human
uguuugaccuaguuagauugugguguuuauuc

SEQ ID NO: 532054 - RNA, 32 nt, Human
uguuugaccuguuucacaggcaucuccuuugu

SEQ ID NO: 532055 - RNA, 32 nt, Human
uguuugacgacaaggaggacgugaacuucgac

SEQ ID NO: 532056 - RNA, 32 nt, Human
uguuugacuagaaccacaucuuaugagguccc

SEQ ID NO: 532057 - RNA, 32 nt, Human
uguuugacucaccaucuuuauuuucuguauau

SEQ ID NO: 532058 - RNA, 32 nt, Human
uguuugacuuuugcuuucuaccugacccuagu

SEQ ID NO: 532059 - RNA, 32 nt, Human
uguuugagaaugcaaauguauacuguaagucu

SEQ ID NO: 532060 - RNA, 32 nt, Human
uguuugagacagagucucccucugucacccag

SEQ ID NO: 532061 - RNA, 32 nt, Human
uguuugagacagcaucuugcucugucucccag

SEQ ID NO: 532062 - RNA, 32 nt, Human
uguuugagacagucgcucugucacccaggcug

SEQ ID NO: 532063 - RNA, 32 nt, Human
uguuugagauagagucuugcuaguguugccca

SEQ ID NO: 532064 - RNA, 32 nt, Human
uguuugagcccaacacuuuaauuuauucuuuc

SEQ ID NO: 532065 - RNA, 32 nt, Human
uguuugagcccaggagguugaggcugcaguga

SEQ ID NO: 532066 - RNA, 32 nt, Human
uguuugagcccuggagguugaggcugcaguga

SEQ ID NO: 532067 - RNA, 32 nt, Human
uguuugagcucagacccccacucucauucccc

SEQ ID NO: 532068 - RNA, 32 nt, Human
uguuugaggaaggcacaugaaucagggccauu

SEQ ID NO: 532069 - RNA, 32 nt, Human
uguuugagggaggaggaaggaggaucagaguu

SEQ ID NO: 532070 - RNA, 32 nt, Human
uguuugagggggaaugaccucuaacaucugua

SEQ ID NO: 532071 - RNA, 32 nt, Human
uguuugagugaguggcugagugcagugucuuu

SEQ ID NO: 532072 - RNA, 32 nt, Human
uguuugaguuccaaucuuacauuuuauaccaa

SEQ ID NO: 532073 - RNA, 31 nt, Human
uguuugauacucaguaccuguuuuaagaaaa

SEQ ID NO: 532074 - RNA, 32 nt, Human
uguuugauagcagaagaaaaaguugcagucuc

SEQ ID NO: 532075 - RNA, 32 nt, Human
uguuugaucuguugaccccagcauacugcugu

SEQ ID NO: 532076 - RNA, 32 nt, Human
uguuugauuugcagaggcauggugaggaauuu

SEQ ID NO: 532077 - RNA, 32 nt, Human
uguuugcaagauaggccaaaaugaguacaaaa

SEQ ID NO: 532078 - RNA, 32 nt, Human
uguuugcacagaaacaugcugcaccccaccca

SEQ ID NO: 532079 - RNA, 32 nt, Human
uguuugcacagcuguucuuuguacccuguucc

SEQ ID NO: 532080 - RNA, 32 nt, Human
uguuugcaccugcuggguauggccuuuggggc

SEQ ID NO: 532081 - RNA, 32 nt, Human
uguuugcagaaaccuugucuuauuuagugucu

SEQ ID NO: 532082 - RNA, 31 nt, Human
uguuugcagagagucagggaggcggaaaaga

SEQ ID NO: 532083 - RNA, 32 nt, Human
uguuugcagcauugcacuccagccugggugac

SEQ ID NO: 532084 - RNA, 32 nt, Human
uguuugcagcggcccaacuggccggcagccug

SEQ ID NO: 532085 - RNA, 32 nt, Human
uguuugcagguuuaaauaaaacaguguggugc

SEQ ID NO: 532086 - RNA, 26 nt, Human
uguuugcagugagagugacuugcugu

SEQ ID NO: 532087 - RNA, 32 nt, Human
uguuugcauagugaacagccuugggagggaga

SEQ ID NO: 532088 - RNA, 32 nt, Human
uguuugcaucaaguaauuuucuuuuugacuua

SEQ ID NO: 532089 - RNA, 32 nt, Human
uguuugcaucacugcacuccagccugggcagc

SEQ ID NO: 532090 - RNA, 32 nt, Human
uguuugcauuccaugaagcuuaaauaagaauu

SEQ ID NO: 532091 - RNA, 32 nt, Human
uguuugcauucugcuccucgcuugccugaaaa

SEQ ID NO: 532092 - RNA, 32 nt, Human
uguuugcauuuaagaugacagugagaaaauga

SEQ ID NO: 532093 - RNA, 32 nt, Human
uguuugccaaagaaauuucauuuggcugugaa

SEQ ID NO: 532094 - RNA, 32 nt, Human
uguuugccaagaacccaggucacugcuaagaa

SEQ ID NO: 532095 - RNA, 32 nt, Human
uguuugccaagugccuggcccagagcaagugg

SEQ ID NO: 532096 - RNA, 32 nt, Human
uguuugccagcucaggagcugucuccucucua

SEQ ID NO: 532097 - RNA, 32 nt, Human
uguuugcccagccuguccuuccagagccucac

SEQ ID NO: 532098 - RNA, 32 nt, Human
uguuugcccaucucuucuuaguggaacuuuag

SEQ ID NO: 532099 - RNA, 32 nt, Human
uguuugccgaguggagugggaaaggcauuuug

SEQ ID NO: 532100 - RNA, 32 nt, Human
uguuugccucagcucuggaagcugacuucuga

SEQ ID NO: 532101 - RNA, 32 nt, Human
uguuugccuccaggagaaccuacaggcaagac

SEQ ID NO: 532102 - RNA, 32 nt, Human
uguuugccucucagucuuucauucauagccug

SEQ ID NO: 532103 - RNA, 32 nt, Human
uguuugccucuccuuaacauguccucagcuga

SEQ ID NO: 532104 - RNA, 32 nt, Human
uguuugccucucuugaaaauggcaggugcucu

SEQ ID NO: 532105 - RNA, 32 nt, Human
uguuugccucuuuccuccuccccacucuaccc

SEQ ID NO: 532106 - RNA, 32 nt, Human
uguuugccuggauccaguccugccacaagcca

SEQ ID NO: 532107 - RNA, 32 nt, Human
uguuugccugugugugcguugugaacuucaag

SEQ ID NO: 532108 - RNA, 32 nt, Human
uguuugccuugcagcugagggauuuucacagu

SEQ ID NO: 532109 - RNA, 32 nt, Human
uguuugcggcgaggagaaaggaaggagaggag

SEQ ID NO: 532110 - RNA, 32 nt, Human
uguuugcgugugugugcgugcgcaugugcuuc

SEQ ID NO: 532111 - RNA, 32 nt, Human
uguuugcguugagccuugcagcucuuccagcu

SEQ ID NO: 532112 - RNA, 20 nt, Human
uguuugcuagcugccuccau

SEQ ID NO: 532113 - RNA, 32 nt, Human
uguuugcuauuuauuuuucuccuucacauuuu

SEQ ID NO: 532114 - RNA, 32 nt, Human
uguuugcucccggagcucugcgggcacccgga

SEQ ID NO: 532115 - RNA, 32 nt, Human
uguuugcugcaagcagaauauuuuggggagag

SEQ ID NO: 532116 - RNA, 32 nt, Human
uguuugcugggagcuucucugcugcuuaaauu

SEQ ID NO: 532117 - RNA, 32 nt, Human
uguuugcuuccacuucccagcagacaugcucu

SEQ ID NO: 532118 - RNA, 32 nt, Human
uguuugcuuccugauuagauccagucaauguu

SEQ ID NO: 532119 - RNA, 32 nt, Human
uguuugcuugagaaaagcaaaaaugcuaacaa

SEQ ID NO: 532120 - RNA, 32 nt, Human
uguuugcuugcaucauggaagcagcauuggaa

SEQ ID NO: 532121 - RNA, 32 nt, Human
uguuugcuuuccggacggaaggacggaaaaag

SEQ ID NO: 532122 - RNA, 32 nt, Human
uguuugcuuugugauaaaauguuaacaaucca

SEQ ID NO: 532123 - RNA, 32 nt, Human
uguuugcuuuucuugaauucaucagaacacaa

SEQ ID NO: 532124 - RNA, 32 nt, Human
uguuugcuuuuggagcucuucagaugcugucc

SEQ ID NO: 532125 - RNA, 32 nt, Human
uguuuggaaagggagagaagagaugucugagg

SEQ ID NO: 532126 - RNA, 32 nt, Human
uguuuggaaauaugguuggaagcacaauucau

SEQ ID NO: 532127 - RNA, 32 nt, Human
uguuuggacaaaaacuacaugaucucaaaaug

SEQ ID NO: 532128 - RNA, 32 nt, Human
uguuuggacccaggagaguggaagagagauug

SEQ ID NO: 532129 - RNA, 32 nt, Human
uguuuggacugagguaccuguacuucuugggu

SEQ ID NO: 532130 - RNA, 32 nt, Human
uguuuggacugcaguuugccacccugagaaca

SEQ ID NO: 532131 - RNA, 32 nt, Human
uguuuggacuucuuccugugccagguccaagu

SEQ ID NO: 532132 - RNA, 32 nt, Human
uguuuggagauucuguuuuacucugccuagag

SEQ ID NO: 532133 - RNA, 32 nt, Human
uguuuggagcauugcugcccagaagcuucuau

SEQ ID NO: 532134 - RNA, 32 nt, Human
uguuuggagcuggugaccuugggcccagcaca

SEQ ID NO: 532135 - RNA, 32 nt, Human
uguuuggaggcuggaugggauaugaucacugg

SEQ ID NO: 532136 - RNA, 32 nt, Human
uguuuggaugauaccugcucuuuauuucagga

SEQ ID NO: 532137 - RNA, 32 nt, Human
uguuuggcaaugugcuguuaaaguaauagacu

SEQ ID NO: 532138 - RNA, 32 nt, Human
uguuuggcaggaccuucccaucugggauccau

SEQ ID NO: 532139 - RNA, 32 nt, Human
uguuuggcagguuaccgauggggaagauucuu

SEQ ID NO: 532140 - RNA, 32 nt, Human
uguuuggcauguaaauguaaacucagcaucaa

SEQ ID NO: 532141 - RNA, 32 nt, Human
uguuuggcgagagagcgauggugccgugggga

SEQ ID NO: 532142 - RNA, 32 nt, Human
uguuuggcggcccuuuuuguucccaucaucua

SEQ ID NO: 532143 - RNA, 32 nt, Human
uguuuggcguugcacacacacauccaccggug

SEQ ID NO: 532144 - RNA, 32 nt, Human
uguuuggcuuaaacgucaaaagccgugacaau

SEQ ID NO: 532145 - RNA, 32 nt, Human
uguuugggagaaugcacaggccagucaggaga

SEQ ID NO: 532146 - RNA, 32 nt, Human
uguuugggauacaaagggguaaguguccccuc

SEQ ID NO: 532147 - RNA, 32 nt, Human
uguuugggauuuccuuuucuuucuuuccuuuu

SEQ ID NO: 532148 - RNA, 32 nt, Human
uguuugggcauggaggcuugccccagaugggg

SEQ ID NO: 532149 - RNA, 32 nt, Human
uguuugggcuaguggguuucugacagcccaug

SEQ ID NO: 532150 - RNA, 32 nt, Human
uguuugggcuucaagcacugucuuccaucugc

SEQ ID NO: 532151 - RNA, 32 nt, Human
uguuugggcuuccuaaugauucuuggaggagg

SEQ ID NO: 532152 - RNA, 32 nt, Human
uguuuggggcaguggggagcaaaccuagauaa

SEQ ID NO: 532153 - RNA, 31 nt, Human
uguuuggggucagucaguguuggagagccca

SEQ ID NO: 532154 - RNA, 32 nt, Human
uguuuggggucccuuggccccuccaguuuccc

SEQ ID NO: 532155 - RNA, 32 nt, Human
uguuuggguacuguauaugagaucaggaaaaa

SEQ ID NO: 532156 - RNA, 32 nt, Human
uguuuggguagaucggaaugaguuguugagcu

SEQ ID NO: 532157 - RNA, 32 nt, Human
uguuugggugggaagggaagagagggauaaga

SEQ ID NO: 532158 - RNA, 32 nt, Human
uguuuggguuuguaaaauaaagugagauagca

SEQ ID NO: 532159 - RNA, 31 nt, Human
uguuugguauuuuucugacaaaauuaagaaa

SEQ ID NO: 532160 - RNA, 32 nt, Human
uguuuggucauugaggguuuguuuguguuuuc

SEQ ID NO: 532161 - RNA, 23 nt, Human
uguuuggucuuuaggccugcgga

SEQ ID NO: 532162 - RNA, 32 nt, Human
uguuuggugaccuacuucacugaccugugagg

SEQ ID NO: 532163 - RNA, 22 nt, Human
uguuuggugcagacacugugga

SEQ ID NO: 532164 - RNA, 32 nt, Human
uguuuggugcaucuugaccugggaagacgccu

SEQ ID NO: 532165 - RNA, 32 nt, Human
uguuugguuucuccaaaguucccaccauaaaa

SEQ ID NO: 532166 - RNA, 32 nt, Human
uguuuguaaccagaagcuuuaaaccagcagag

SEQ ID NO: 532167 - RNA, 32 nt, Human
uguuuguaauuucacuuucaucuugcuuaaua

SEQ ID NO: 532168 - RNA, 31 nt, Human
uguuuguacagcuagaauauauuaguaagau

SEQ ID NO: 532169 - RNA, 32 nt, Human
uguuuguacauacuuauuuccuagcucugucu

SEQ ID NO: 532170 - RNA, 32 nt, Human
uguuuguagagagaaagccaggagguaagagc

SEQ ID NO: 532171 - RNA, 32 nt, Human
uguuuguagcaguuguuugucucauuuuugcu

SEQ ID NO: 532172 - RNA, 32 nt, Human
uguuuguauacguguucacagggcacggaaaa

SEQ ID NO: 532173 - RNA, 32 nt, Human
uguuuguauuuuuagcagagaugggguuucac

SEQ ID NO: 532174 - RNA, 32 nt, Human
uguuuguauuuuuaguagagacaggguuucac

SEQ ID NO: 532175 - RNA, 32 nt, Human
uguuuguauuuuuaguagagacaggguuucau

SEQ ID NO: 532176 - RNA, 32 nt, Human
uguuugucaaauaccacaguauuuuauucauu

SEQ ID NO: 532177 - RNA, 32 nt, Human
uguuugucaccucauauuuaaagcuuuguuuu

SEQ ID NO: 532178 - RNA, 32 nt, Human
uguuugucaccucccuacuccugucauuacau

SEQ ID NO: 532179 - RNA, 32 nt, Human
uguuugucauguauugguacaagcagauacag

SEQ ID NO: 532180 - RNA, 32 nt, Human
uguuugucauucuuaucuccagccugggaaaa

SEQ ID NO: 532181 - RNA, 32 nt, Human
uguuugucccaacaaccucuggccccagcacc

SEQ ID NO: 532182 - RNA, 23 nt, Human
uguuugucccuggacuggccaug

SEQ ID NO: 532183 - RNA, 32 nt, Human
uguuugucuacugcacaagccucggccugccc

SEQ ID NO: 532184 - RNA, 32 nt, Human
uguuugucuccuccuccuccugcuuccccugc

SEQ ID NO: 532185 - RNA, 22 nt, Human
uguuugucuguauuugcacaug

SEQ ID NO: 532186 - RNA, 32 nt, Human
uguuugucuuccauuccauuguuuugaaacuc

SEQ ID NO: 532187 - RNA, 32 nt, Human
uguuugugacaacuaaacaaggcauucagcag

SEQ ID NO: 532188 - RNA, 32 nt, Human
uguuugugauggucucugguucuugaacagcc

SEQ ID NO: 532189 - RNA, 32 nt, Human
uguuugugauugucugugugucugucuccccc

SEQ ID NO: 532190 - RNA, 32 nt, Human
uguuugugccuuucaaaaguacugggggcaga

SEQ ID NO: 532191 - RNA, 32 nt, Human
uguuugugcugguagugguggcaguggugaug

SEQ ID NO: 532192 - RNA, 32 nt, Human
uguuuguggaaaaugaguaaauucagccucaa

SEQ ID NO: 532193 - RNA, 32 nt, Human
uguuuguguaacaaacaggucuuuuggcuuau

SEQ ID NO: 532194 - RNA, 32 nt, Human
uguuugugucccacccuucacccccaaauucc

SEQ ID NO: 532195 - RNA, 32 nt, Human
uguuugugucugcagaagcgcccaucugauau

SEQ ID NO: 532196 - RNA, 29 nt, Human
uguuugugucugucugugggucucgaagg

SEQ ID NO: 532197 - RNA, 29 nt, Human
uguuugugucugugcugcguuugugagcu

SEQ ID NO: 532198 - RNA, 32 nt, Human
uguuuguguggacuccaccaucauguugaauu

SEQ ID NO: 532199 - RNA, 32 nt, Human
uguuuguguguagagacgggggauagugagaa

SEQ ID NO: 532200 - RNA, 32 nt, Human
uguuuguuaaugaugucuucaguucugguacc

SEQ ID NO: 532201 - RNA, 32 nt, Human
uguuuguuauccuuucucuguggcagugaaga

SEQ ID NO: 532202 - RNA, 32 nt, Human
uguuuguucaaagaacaguggaagagaagcau

SEQ ID NO: 532203 - RNA, 32 nt, Human
uguuuguucagacagucuguucuuuuguaaac

SEQ ID NO: 532204 - RNA, 32 nt, Human
uguuuguucaucaccuacuaugugucaggcuc

SEQ ID NO: 532205 - RNA, 25 nt, Human
uguuuguuccaaaaccaucauuuaa

SEQ ID NO: 532206 - RNA, 32 nt, Human
uguuuguugaaugcugcugcccaacucuuccu

SEQ ID NO: 532207 - RNA, 32 nt, Human
uguuuguuggcagacagggucucacuuuguca

SEQ ID NO: 532208 - RNA, 21 nt, Human
uguuuguugugucuugcuaua

SEQ ID NO: 532209 - RNA, 23 nt, Human
uguuuguuucaaucugcuuuuga

SEQ ID NO: 532210 - RNA, 24 nt, Human
uguuuguuucaauuggccauuuaa

SEQ ID NO: 532211 - RNA, 24 nt, Human
uguuuguuucaauugggcacuuaa

SEQ ID NO: 532212 - RNA, 32 nt, Human
uguuuguuucauuugccuuggagccaaaguuu

SEQ ID NO: 532213 - RNA, 32 nt, Human
uguuuguuucuguuauguuaccauaauuugau

SEQ ID NO: 532214 - RNA, 32 nt, Human
uguuuguuucuuucuuucuuucacaugacugc

SEQ ID NO: 532215 - RNA, 32 nt, Human
uguuuguuugagauggagucucacucugucac

SEQ ID NO: 532216 - RNA, 32 nt, Human
uguuuguuugagauugagucuugcucuuguuu

SEQ ID NO: 532217 - RNA, 26 nt, Human
uguuuguuugcgauggagucucacuc

SEQ ID NO: 532218 - RNA, 20 nt, Human
uguuuguuugguuugccaug

SEQ ID NO: 532219 - RNA, 32 nt, Human
uguuuguuuucagucuuugcacuauauuacca

SEQ ID NO: 532220 - RNA, 32 nt, Human
uguuuguuuucccuuccccauuuccuuccuuc

SEQ ID NO: 532221 - RNA, 32 nt, Human
uguuuguuuucgaaugccuuguuuucauagag

SEQ ID NO: 532222 - RNA, 32 nt, Human
uguuuguuuugccucuucuguuucuuggagga

SEQ ID NO: 532223 - RNA, 32 nt, Human
uguuuguuuuugacacagucucgcuuuguugc

SEQ ID NO: 532224 - RNA, 21 nt, Human
uguuuguuuuugcuuguuaua

SEQ ID NO: 532225 - RNA, 22 nt, Human
uguuuuaaaaaugaacuucucc

SEQ ID NO: 532226 - RNA, 32 nt, Human
uguuuuaaaugauuucuugagaauaagcaaug

SEQ ID NO: 532227 - RNA, 32 nt, Human
uguuuuaacauguaauugugggagaaauugua

SEQ ID NO: 532228 - RNA, 32 nt, Human
uguuuuaacuuagguauggguaaauuuacauc

SEQ ID NO: 532229 - RNA, 32 nt, Human
uguuuuaagcuacagcucuaguucauugugau

SEQ ID NO: 532230 - RNA, 32 nt, Human
uguuuuaagugguauggauauauuuagcauau

SEQ ID NO: 532231 - RNA, 32 nt, Human
uguuuuaauagcuguauaauagcaucugucug

SEQ ID NO: 532232 - RNA, 32 nt, Human
uguuuuaaucccacccuuccauccauaccucu

SEQ ID NO: 532233 - RNA, 32 nt, Human
uguuuuacacagagaaacagguagaccccaca

SEQ ID NO: 532234 - RNA, 32 nt, Human
uguuuuacagcagaggaaagaggaucacagag

SEQ ID NO: 532235 - RNA, 32 nt, Human
uguuuuacaguuuuuccagccauucuuuucuu

SEQ ID NO: 532236 - RNA, 32 nt, Human
uguuuuacccuauacauccacaggguuuugac

SEQ ID NO: 532237 - RNA, 32 nt, Human
uguuuuagaagaggcagaacagugauaaagac

SEQ ID NO: 532238 - RNA, 19 nt, Human
uguuuuagacuccuucccc

SEQ ID NO: 532239 - RNA, 18 nt, Human
uguuuuagagacuacaaa

SEQ ID NO: 532240 - RNA, 23 nt, Human
uguuuuagagaucauccgaggac

SEQ ID NO: 532241 - RNA, 32 nt, Human
uguuuuagcaagcauuaaagcaaauguauggc

SEQ ID NO: 532242 - RNA, 32 nt, Human
uguuuuaguacaaauauccagggacaaacucu

SEQ ID NO: 532243 - RNA, 32 nt, Human
uguuuuaguagagguggggucuugccacauug

SEQ ID NO: 532244 - RNA, 32 nt, Human
uguuuuagucucuugauuuuguauccacuuuc

SEQ ID NO: 532245 - RNA, 31 nt, Human
uguuuuauacucaguaccuguuuuaagaaaa

SEQ ID NO: 532246 - RNA, 32 nt, Human
uguuuuauacuucuaugcuauauuuugcuauu

SEQ ID NO: 532247 - RNA, 32 nt, Human
uguuuuauagaacguuuccgcugcaguaagcc

SEQ ID NO: 532248 - RNA, 32 nt, Human
uguuuuaucuuuuccagaugugaauggaauca

SEQ ID NO: 532249 - RNA, 32 nt, Human
uguuuuaugagacuugcugggagcucugcuuu

SEQ ID NO: 532250 - RNA, 32 nt, Human
uguuuuauuaacaucagacaucuuuguuccua

SEQ ID NO: 532251 - RNA, 32 nt, Human
uguuuuauuaccuguugcagaagcgguuaucu

SEQ ID NO: 532252 - RNA, 32 nt, Human
uguuuuauugaaugagcuauaagacaacauuu

SEQ ID NO: 532253 - RNA, 32 nt, Human
uguuuuauugauuucaaggaagugguuaauca

SEQ ID NO: 532254 - RNA, 32 nt, Human
uguuuuauuucaccuaaaauguuagcauuauc

SEQ ID NO: 532255 - RNA, 32 nt, Human
uguuuuauuuuccugugagucuugcgaggugg

SEQ ID NO: 532256 - RNA, 24 nt, Human
uguuuucaaaagugccuugccaug

SEQ ID NO: 532257 - RNA, 32 nt, Human
uguuuucaaaggcuuugcacuggagaagauau

SEQ ID NO: 532258 - RNA, 19 nt, Human
uguuuucaagaccaucaca

SEQ ID NO: 532259 - RNA, 32 nt, Human
uguuuucacauccuuucccuuacccaccuuca

SEQ ID NO: 532260 - RNA, 32 nt, Human
uguuuucacaucuuucauuagauguguguaag

SEQ ID NO: 532261 - RNA, 32 nt, Human
uguuuucacugcacauuuucaggcuugguuuc

SEQ ID NO: 532262 - RNA, 32 nt, Human
uguuuucacuggguuccaccagucccagcaaa

SEQ ID NO: 532263 - RNA, 32 nt, Human
uguuuucagaaaugagggcagcuguuaauuuu

SEQ ID NO: 532264 - RNA, 32 nt, Human
uguuuucagaauuacagugagcacagaggugu

SEQ ID NO: 532265 - RNA, 32 nt, Human
uguuuucaguaucaucuggcacacaacugucc

SEQ ID NO: 532266 - RNA, 32 nt, Human
uguuuucagugcugugucauuccaaauaaacc

SEQ ID NO: 532267 - RNA, 32 nt, Human
uguuuucaguuauauuacuuuugaggcuggug

SEQ ID NO: 532268 - RNA, 32 nt, Human
uguuuucaucuauuuggguacgaagugugcaa

SEQ ID NO: 532269 - RNA, 32 nt, Human
uguuuucauucucccccucucucccuccugug

SEQ ID NO: 532270 - RNA, 32 nt, Human
uguuuucauuucugaaguuuaagaugccuuga

SEQ ID NO: 532271 - RNA, 22 nt, Human
uguuuuccaaggcuuccuccac

SEQ ID NO: 532272 - RNA, 32 nt, Human
uguuuuccaauugaucgagguggagaauguuu

SEQ ID NO: 532273 - RNA, 32 nt, Human
uguuuuccacuagucacuacugucuucuccuu

SEQ ID NO: 532274 - RNA, 32 nt, Human
uguuuuccacugaagcaugcacaugccacugu

SEQ ID NO: 532275 - RNA, 32 nt, Human
uguuuuccagccugggcaauacagugagaccc

SEQ ID NO: 532276 - RNA, 32 nt, Human
uguuuuccaugguuuugacauucuuuggacug

SEQ ID NO: 532277 - RNA, 32 nt, Human
uguuuucccccacucucucuccaccuccuccu

SEQ ID NO: 532278 - RNA, 32 nt, Human
uguuuuccgaacccaucuccuuccgcucuccc

SEQ ID NO: 532279 - RNA, 32 nt, Human
uguuuuccuagaguguuuguuaucaugaacau

SEQ ID NO: 532280 - RNA, 32 nt, Human
uguuuuccuccccucuguguacucccuuaaau

SEQ ID NO: 532281 - RNA, 32 nt, Human
uguuuuccucccucuccucuggcugcuacaac

SEQ ID NO: 532282 - RNA, 32 nt, Human
uguuuuccugcagcuguugacuuguugcccug

SEQ ID NO: 532283 - RNA, 32 nt, Human
uguuuuccugggugaagacuucugggggcaga

SEQ ID NO: 532284 - RNA, 32 nt, Human
uguuuuccugucuuuugacauuugacuuugca

SEQ ID NO: 532285 - RNA, 32 nt, Human
uguuuuccuguuccuguucacuccugcuggaa

SEQ ID NO: 532286 - RNA, 32 nt, Human
uguuuucguucuguuuuauuuuucuaacucug

SEQ ID NO: 532287 - RNA, 32 nt, Human
uguuuucuacugcaaaccuccacauccuggaa

SEQ ID NO: 532288 - RNA, 32 nt, Human
uguuuucucacagcagcugccugggugaagca

SEQ ID NO: 532289 - RNA, 21 nt, Human
uguuuucucccacugccucca

SEQ ID NO: 532290 - RNA, 32 nt, Human
uguuuucucccauguuccauguuuccgauuua

SEQ ID NO: 532291 - RNA, 32 nt, Human
uguuuucuccccagucaucuuauuuggcuaug

SEQ ID NO: 532292 - RNA, 32 nt, Human
uguuuucucugccuggcucucucuuccccucc

SEQ ID NO: 532293 - RNA, 32 nt, Human
uguuuucucuguucucuuucuggaacuccuuu

SEQ ID NO: 532294 - RNA, 32 nt, Human
uguuuucucuucccaaagcuugcucaggcccc

SEQ ID NO: 532295 - RNA, 32 nt, Human
uguuuucugaaaccaggaugaugcucauucag

SEQ ID NO: 532296 - RNA, 32 nt, Human
uguuuucugaagaagggucuucaguauucagc

SEQ ID NO: 532297 - RNA, 32 nt, Human
uguuuucugcaaggagcugccagccaucuaac

SEQ ID NO: 532298 - RNA, 32 nt, Human
uguuuucuggcaggugcccuccuuggaaacug

SEQ ID NO: 532299 - RNA, 32 nt, Human
uguuuucuggguuagaagcuauucgaaaaguc

SEQ ID NO: 532300 - RNA, 32 nt, Human
uguuuucuguaaccccuguuugugguacgaga

SEQ ID NO: 532301 - RNA, 32 nt, Human
uguuuucugucuucaugagucaaaauuugaag

SEQ ID NO: 532302 - RNA, 32 nt, Human
uguuuucuuaguuucauaauaaucugcacugu

SEQ ID NO: 532303 - RNA, 32 nt, Human
uguuuucuucccuccaccuccaccccuuucuu

SEQ ID NO: 532304 - RNA, 32 nt, Human
uguuuucuucuuuucuuacugcgcauuuccau

SEQ ID NO: 532305 - RNA, 32 nt, Human
uguuuucuucuuuuuguucuuuuugcuuauau

SEQ ID NO: 532306 - RNA, 19 nt, Human
uguuuucuugacuaugucu

SEQ ID NO: 532307 - RNA, 32 nt, Human
uguuuucuuuaccuuuuuccuccaugcaccau

SEQ ID NO: 532308 - RNA, 32 nt, Human
uguuuucuuuuccccucuucuuuuucacaaau

SEQ ID NO: 532309 - RNA, 32 nt, Human
uguuuucuuuucugugguugcagccugaccaa

SEQ ID NO: 532310 - RNA, 32 nt, Human
uguuuucuuuucuuccccuuguguuuccaguc

SEQ ID NO: 532311 - RNA, 25 nt, Human
uguuuugaaaauauucacuaacaua

SEQ ID NO: 532312 - RNA, 32 nt, Human
uguuuugaaagaauagaacacaguuuguagug

SEQ ID NO: 532313 - RNA, 32 nt, Human
uguuuugaagaaagaagaguagaagaaaaagu

SEQ ID NO: 532314 - RNA, 32 nt, Human
uguuuugaagcagcagguccaggucacuuugu

SEQ ID NO: 532315 - RNA, 32 nt, Human
uguuuugaaggagaggacagugugucuggcca

SEQ ID NO: 532316 - RNA, 32 nt, Human
uguuuugagacagggccucacucuguugccca

SEQ ID NO: 532317 - RNA, 32 nt, Human
uguuuugagacagggucucacucuguugccca

SEQ ID NO: 532318 - RNA, 32 nt, Human
uguuuugagacagggucucacuguguccccca

SEQ ID NO: 532319 - RNA, 32 nt, Human
uguuuugagacagggucucacuuugucaccca

SEQ ID NO: 532320 - RNA, 32 nt, Human
uguuuugagacagggucucauucugaugccca

SEQ ID NO: 532321 - RNA, 32 nt, Human
uguuuugagacagggucuugcccuguugccca

SEQ ID NO: 532322 - RNA, 32 nt, Human
uguuuugagaggaggagggaagagaaauaaac

SEQ ID NO: 532323 - RNA, 32 nt, Human
uguuuugagauggagucucacucugucaccca

SEQ ID NO: 532324 - RNA, 32 nt, Human
uguuuugagauggagucucgcucugucaccca

SEQ ID NO: 532325 - RNA, 32 nt, Human
uguuuugagauggagucuugcccugucaccca

SEQ ID NO: 532326 - RNA, 32 nt, Human
uguuuugagauggagucuuguucugucaccca

SEQ ID NO: 532327 - RNA, 32 nt, Human
uguuuugagauggaguuuugcucuugcacucc

SEQ ID NO: 532328 - RNA, 32 nt, Human
uguuuugaggcagcaugguuugauuagcauuu

SEQ ID NO: 532329 - RNA, 32 nt, Human
uguuuugaggcagggucucgcucugucaccga

SEQ ID NO: 532330 - RNA, 32 nt, Human
uguuuugaggguggaaugaggugaagggcaag

SEQ ID NO: 532331 - RNA, 32 nt, Human
uguuuugaucacugcugcuugagccccgcuau

SEQ ID NO: 532332 - RNA, 32 nt, Human
uguuuugaugcuuagauuauguucuguuaaug

SEQ ID NO: 532333 - RNA, 32 nt, Human
uguuuugcaaaucaggagguugggcuagauca

SEQ ID NO: 532334 - RNA, 32 nt, Human
uguuuugcacugacagugggaggggauaaggu

SEQ ID NO: 532335 - RNA, 32 nt, Human
uguuuugcagcccaggcuggagugcaguggca

SEQ ID NO: 532336 - RNA, 32 nt, Human
uguuuugcaguggugacuggccuaggcagguu

SEQ ID NO: 532337 - RNA, 32 nt, Human
uguuuugcaucaagcuggaguacuggauggaa

SEQ ID NO: 532338 - RNA, 32 nt, Human
uguuuugccauguuggccaggcuggucucgaa

SEQ ID NO: 532339 - RNA, 32 nt, Human
uguuuugccauguuggccaggcuggucuugaa

SEQ ID NO: 532340 - RNA, 32 nt, Human
uguuuugccugaaguuggagugaguguggcuc

SEQ ID NO: 532341 - RNA, 32 nt, Human
uguuuugcucccgucuccgacgagagaggcgg

SEQ ID NO: 532342 - RNA, 32 nt, Human
uguuuugcugggaagauagaccuggguggagg

SEQ ID NO: 532343 - RNA, 32 nt, Human
uguuuuggagcuucaagacuuugcauuuccua

SEQ ID NO: 532344 - RNA, 32 nt, Human
uguuuuggagugaaaggagcuugaaggucaug

SEQ ID NO: 532345 - RNA, 32 nt, Human
uguuuuggauagaaagccccuuuugcucagua

SEQ ID NO: 532346 - RNA, 32 nt, Human
uguuuuggcaccugccuguaaucucagcuacu

SEQ ID NO: 532347 - RNA, 32 nt, Human
uguuuuggccacuucuguuggccaugaguguc

SEQ ID NO: 532348 - RNA, 32 nt, Human
uguuuuggcucccaaucagcagucuucaaucg

SEQ ID NO: 532349 - RNA, 32 nt, Human
uguuuuggcugcagagagugguucauccauac

SEQ ID NO: 532350 - RNA, 32 nt, Human
uguuuuggcugcagcggugucuggggugaugu

SEQ ID NO: 532351 - RNA, 32 nt, Human
uguuuugggcuucuuguaaauccccaguuccu

SEQ ID NO: 532352 - RNA, 32 nt, Human
uguuuuggggaagugaaauaugugguugguag

SEQ ID NO: 532353 - RNA, 32 nt, Human
uguuuuggggaccagguagggaggcuguugaa

SEQ ID NO: 532354 - RNA, 32 nt, Human
uguuuuggggucuuaggguacagcccaggcgg

SEQ ID NO: 532355 - RNA, 32 nt, Human
uguuuugggugagacagagggaaagggaaaaa

SEQ ID NO: 532356 - RNA, 32 nt, Human
uguuuuggguuagagagaguaagauuugagaa

SEQ ID NO: 532357 - RNA, 32 nt, Human
uguuuugguggcagaggugggaugagcuggaa

SEQ ID NO: 532358 - RNA, 22 nt, Human
uguuuugguggcauccaaagac

SEQ ID NO: 532359 - RNA, 28 nt, Human
uguuuuguaagugcugcuauaucuaucc

SEQ ID NO: 532360 - RNA, 32 nt, Human
uguuuuguacagugccuggcacucugggugcu

SEQ ID NO: 532361 - RNA, 32 nt, Human
uguuuuguacaucuaauuuugggaaaccaagu

SEQ ID NO: 532362 - RNA, 32 nt, Human
uguuuuguaguguugcuuagcacuuugcgcau

SEQ ID NO: 532363 - RNA, 32 nt, Human
uguuuuguauuucucuggagugcaauggugca

SEQ ID NO: 532364 - RNA, 32 nt, Human
uguuuugucacccaggcuggagugcagugggg

SEQ ID NO: 532365 - RNA, 32 nt, Human
uguuuugucacccaggcuggagugcaguggug

SEQ ID NO: 532366 - RNA, 32 nt, Human
uguuuugucauccugagucccagaggggugaa

SEQ ID NO: 532367 - RNA, 21 nt, Human
uguuuugugaauacugacaca

SEQ ID NO: 532368 - RNA, 32 nt, Human
uguuuugugacuggcuucauuuacuuagcaua

SEQ ID NO: 532369 - RNA, 32 nt, Human
uguuuuguggaaauagauguguuugcaauuug

SEQ ID NO: 532370 - RNA, 32 nt, Human
uguuuugugguuuccguauuucuucuuuucac

SEQ ID NO: 532371 - RNA, 32 nt, Human
uguuuuguguaaaaugaaauuacuuucucuug

SEQ ID NO: 532372 - RNA, 32 nt, Human
uguuuuguguguguuuuaauucucaucuauga

SEQ ID NO: 532373 - RNA, 24 nt, Human
uguuuuguuauaaugccugauaca

SEQ ID NO: 532374 - RNA, 32 nt, Human
uguuuuguucaucuguucgagcagaggggcag

SEQ ID NO: 532375 - RNA, 32 nt, Human
uguuuuguucccucugccccagagagcucccc

SEQ ID NO: 532376 - RNA, 32 nt, Human
uguuuuguucuagccacacuggcagcuguuag

SEQ ID NO: 532377 - RNA, 32 nt, Human
uguuuuguucuucagcuccucaucaggaucuu

SEQ ID NO: 532378 - RNA, 32 nt, Human
uguuuuguucuuuguuaugcugucuaucucug

SEQ ID NO: 532379 - RNA, 23 nt, Human
uguuuuguugacauucugaaugc

SEQ ID NO: 532380 - RNA, 32 nt, Human
uguuuuguugagauggaguuuugcucuuauug

SEQ ID NO: 532381 - RNA, 32 nt, Human
uguuuuguugucuugugcaguauuuuacagcc

SEQ ID NO: 532382 - RNA, 32 nt, Human
uguuuuguuugucauguauugguacaagcaga

SEQ ID NO: 532383 - RNA, 32 nt, Human
uguuuuguuuuguuuuuaauguauguagcaga

SEQ ID NO: 532384 - RNA, 32 nt, Human
uguuuuguuuuucugcugaaugccugcuccca

SEQ ID NO: 532385 - RNA, 32 nt, Human
uguuuuuaaacccaaaacauuuagugguccgu

SEQ ID NO: 532386 - RNA, 32 nt, Human
uguuuuuaaagaaaggaaaugugcaauauuga

SEQ ID NO: 532387 - RNA, 32 nt, Human
uguuuuuaagagauagggucuugcuguguugc

SEQ ID NO: 532388 - RNA, 32 nt, Human
uguuuuuaagagauggagucucucacucugug

SEQ ID NO: 532389 - RNA, 32 nt, Human
uguuuuuacugucuuuucccagacacacagug

SEQ ID NO: 532390 - RNA, 32 nt, Human
uguuuuuagaguaugauucagagaccaauuua

SEQ ID NO: 532391 - RNA, 32 nt, Human
uguuuuuagaucagugcuucaacauccaggcu

SEQ ID NO: 532392 - RNA, 32 nt, Human
uguuuuuagcuauuucuccacuuguaaugugu

SEQ ID NO: 532393 - RNA, 31 nt, Human
uguuuuuauaaaucagggccuguguucauac

SEQ ID NO: 532394 - RNA, 31 nt, Human
uguuuuuauacuucucaauuuaaauuuucuu

SEQ ID NO: 532395 - RNA, 32 nt, Human
uguuuuuaugaugugcauggacucauugaagu

SEQ ID NO: 532396 - RNA, 32 nt, Human
uguuuuuauguuauuagcuauuuggaguuaaa

SEQ ID NO: 532397 - RNA, 32 nt, Human
uguuuuuauucgcuuucugguaacuucuguag

SEQ ID NO: 532398 - RNA, 32 nt, Human
uguuuuucaaaccuccugcuucucccaccuug

SEQ ID NO: 532399 - RNA, 29 nt, Human
uguuuuucaauaaaaccagaguugaaggc

SEQ ID NO: 532400 - RNA, 31 nt, Human
uguuuuucaauaaauauuuugaaacauguuu

SEQ ID NO: 532401 - RNA, 32 nt, Human
uguuuuucaaugauaggaaacagaaaagccaa

SEQ ID NO: 532402 - RNA, 32 nt, Human
uguuuuucacaucuauacucccugcacccuuc

SEQ ID NO: 532403 - RNA, 32 nt, Human
uguuuuucacugcaccucuuuggaucaugauu

SEQ ID NO: 532404 - RNA, 32 nt, Human
uguuuuucagaaagggcagaagugggggaaga

SEQ ID NO: 532405 - RNA, 32 nt, Human
uguuuuucagauuccuuucacugccuuaaucu

SEQ ID NO: 532406 - RNA, 32 nt, Human
uguuuuucaggccauucaccugccuccuguca

SEQ ID NO: 532407 - RNA, 32 nt, Human
uguuuuucaguaggcuucaauuacaaacaguu

SEQ ID NO: 532408 - RNA, 32 nt, Human
uguuuuucaguuacuuuauauuuauuuuguau

SEQ ID NO: 532409 - RNA, 19 nt, Human
uguuuuucaucucuuccuc

SEQ ID NO: 532410 - RNA, 21 nt, Human
uguuuuuccagacucagcuca

SEQ ID NO: 532411 - RNA, 25 nt, Human
uguuuuuccagcucacccacugcca

SEQ ID NO: 532412 - RNA, 32 nt, Human
uguuuuuccgacacuccugggucagacuccug

SEQ ID NO: 532413 - RNA, 32 nt, Human
uguuuuucuacaacacagaguacugacucugc

SEQ ID NO: 532414 - RNA, 32 nt, Human
uguuuuucuagagugaauuauaguauugacgu

SEQ ID NO: 532415 - RNA, 32 nt, Human
uguuuuucuauuggagacaaaaugaacaucgu

SEQ ID NO: 532416 - RNA, 32 nt, Human
uguuuuucuccuagucccucuccugccaccuc

SEQ ID NO: 532417 - RNA, 32 nt, Human
uguuuuucugucaccuauagagugcaagaaug

SEQ ID NO: 532418 - RNA, 31 nt, Human
uguuuuucuguguaugggccuggucagugua

SEQ ID NO: 532419 - RNA, 23 nt, Human
uguuuuucuguguuguuuucccu

SEQ ID NO: 532420 - RNA, 32 nt, Human
uguuuuucuuuaaaguuucaacaacaaacccc

SEQ ID NO: 532421 - RNA, 24 nt, Human
uguuuuucuuucuguagcauggca

SEQ ID NO: 532422 - RNA, 32 nt, Human
uguuuuucuuuucuaaaaugaagugagauugu

SEQ ID NO: 532423 - RNA, 32 nt, Human
uguuuuugaacagcauaauuguguagcagcac

SEQ ID NO: 532424 - RNA, 32 nt, Human
uguuuuugauccagggagguugaagugucuau

SEQ ID NO: 532425 - RNA, 22 nt, Human
uguuuuugauccucccaccuca

SEQ ID NO: 532426 - RNA, 32 nt, Human
uguuuuugcacccuuuuucaaguacaaaaucg

SEQ ID NO: 532427 - RNA, 32 nt, Human
uguuuuugccuaguuuuucgccaaucuacacu

SEQ ID NO: 532428 - RNA, 32 nt, Human
uguuuuugccuuuguugguucauccuuguuuu

SEQ ID NO: 532429 - RNA, 32 nt, Human
uguuuuugcuccucccucuuuacccuccccuc

SEQ ID NO: 532430 - RNA, 32 nt, Human
uguuuuugcugcagauaaucggccagagacug

SEQ ID NO: 532431 - RNA, 32 nt, Human
uguuuuugcugcucuagcaagaucccugagac

SEQ ID NO: 532432 - RNA, 32 nt, Human
uguuuuugcuucccauguaacuucuccagugu

SEQ ID NO: 532433 - RNA, 32 nt, Human
uguuuuugcuuuccccuuccuccucccucucu

SEQ ID NO: 532434 - RNA, 32 nt, Human
uguuuuuggagggaaucagugggacuauuugu

SEQ ID NO: 532435 - RNA, 32 nt, Human
uguuuuuggagugcuggagugacuugugaauu

SEQ ID NO: 532436 - RNA, 32 nt, Human
uguuuuuggcauuucgagguuuacuuauuuuc

SEQ ID NO: 532437 - RNA, 32 nt, Human
uguuuuuggggaaauuuugaaaaguggaguug

SEQ ID NO: 532438 - RNA, 32 nt, Human
uguuuuugggggaacagggagcauucacaggg

SEQ ID NO: 532439 - RNA, 31 nt, Human
uguuuuuggguucucccucuuugccuaggcu

SEQ ID NO: 532440 - RNA, 32 nt, Human
uguuuuuggucagaauagauaaccucaagcuu

SEQ ID NO: 532441 - RNA, 32 nt, Human
uguuuuuggugguuugggggaugggaggguug

SEQ ID NO: 532442 - RNA, 32 nt, Human
uguuuuugguuuuucuaaauauccaauugguc

SEQ ID NO: 532443 - RNA, 32 nt, Human
uguuuuugucugacuucuacucugucaaucuc

SEQ ID NO: 532444 - RNA, 32 nt, Human
uguuuuuguguuacugggcaugugccccuuua

SEQ ID NO: 532445 - RNA, 32 nt, Human
uguuuuuguuauuaaauggaaaaggccugaau

SEQ ID NO: 532446 - RNA, 22 nt, Human
uguuuuuguucuacucuaggca

SEQ ID NO: 532447 - RNA, 32 nt, Human
uguuuuuguugguaggcgucucgcucugucac

SEQ ID NO: 532448 - RNA, 32 nt, Human
uguuuuuguuuucucuuccaagggccgucccg

SEQ ID NO: 532449 - RNA, 32 nt, Human
uguuuuuguuuugcacaaacuaaaugcagugg

SEQ ID NO: 532450 - RNA, 32 nt, Human
uguuuuuguuuugcacaguaagaaacaauagg

SEQ ID NO: 532451 - RNA, 32 nt, Human
uguuuuuguuuuguuccauuguagcucuuuuu

SEQ ID NO: 532452 - RNA, 21 nt, Human
uuaaaaaacaagauuuauaca

SEQ ID NO: 532453 - RNA, 23 nt, Human
uuaaaaaagauggauuugacaca

SEQ ID NO: 532454 - RNA, 24 nt, Human
uuaaaaaauuguaugauuuacaua

SEQ ID NO: 532455 - RNA, 32 nt, Human
uuaaaaacaaaaccaagcucccuucccuuccu

SEQ ID NO: 532456 - RNA, 32 nt, Human
uuaaaaacaaaugaguuuuuauauaaauaaag

SEQ ID NO: 532457 - RNA, 32 nt, Human
uuaaaaacaacaaagcauuguucuaacuacua

SEQ ID NO: 532458 - RNA, 32 nt, Human
uuaaaaacaacaaauuggccucuuccuaagua

SEQ ID NO: 532459 - RNA, 32 nt, Human
uuaaaaacauaguccugcagguugacuaagaa

SEQ ID NO: 532460 - RNA, 32 nt, Human
uuaaaaacauagugucuucauuagugugcauc

SEQ ID NO: 532461 - RNA, 32 nt, Human
uuaaaaacauugcugccgccuacuucuuccag

SEQ ID NO: 532462 - RNA, 32 nt, Human
uuaaaaaccacuggaacucuuguccaguuuuu

SEQ ID NO: 532463 - RNA, 32 nt, Human
uuaaaaaccccagcugccagagaccccaacac

SEQ ID NO: 532464 - RNA, 32 nt, Human
uuaaaaacucacuguuagugacuuugaugccu

SEQ ID NO: 532465 - RNA, 32 nt, Human
uuaaaaacuggacuuuuuagaaguaaaguaaa

SEQ ID NO: 532466 - RNA, 32 nt, Human
uuaaaaacuguacuguuuuauguuacacauug

SEQ ID NO: 532467 - RNA, 32 nt, Human
uuaaaaacuguucaaaagcaaaagagaaggaa

SEQ ID NO: 532468 - RNA, 32 nt, Human
uuaaaaacuucggaguuuuuccuugcuuaaau

SEQ ID NO: 532469 - RNA, 32 nt, Human
uuaaaaacuucuguaguucuuuuggccagugu

SEQ ID NO: 532470 - RNA, 32 nt, Human
uuaaaaacuuuacuccaaagggagccaaugug

SEQ ID NO: 532471 - RNA, 32 nt, Human
uuaaaaagaaaaauaaaggaccucuggguugu

SEQ ID NO: 532472 - RNA, 32 nt, Human
uuaaaaagaaauucacugguucuuuacaaaau

SEQ ID NO: 532473 - RNA, 32 nt, Human
uuaaaaagaaccucgcuucuuccucacggugc

SEQ ID NO: 532474 - RNA, 32 nt, Human
uuaaaaagaaggcuuacaauuagccaggcgug

SEQ ID NO: 532475 - RNA, 32 nt, Human
uuaaaaagacuugguucagcuggucacggugg

SEQ ID NO: 532476 - RNA, 32 nt, Human
uuaaaaagagcauuaagcuuaaaugaguuuuu

SEQ ID NO: 532477 - RNA, 32 nt, Human
uuaaaaagagugaggaagaagcagaaugauug

SEQ ID NO: 532478 - RNA, 32 nt, Human
uuaaaaagauuuugaaagcuugcucaauaaug

SEQ ID NO: 532479 - RNA, 32 nt, Human
uuaaaaagccauguguggaaacccacuauuua

SEQ ID NO: 532480 - RNA, 32 nt, Human
uuaaaaagcugcacgcaaguguuaaacuucug

SEQ ID NO: 532481 - RNA, 32 nt, Human
uuaaaaaggaaaauaaaggaccucugggcugu

SEQ ID NO: 532482 - RNA, 32 nt, Human
uuaaaaaggaaggaaggagcaagugaaguuuc

SEQ ID NO: 532483 - RNA, 32 nt, Human
uuaaaaaggaagggaaaagucuuuuguugccc

SEQ ID NO: 532484 - RNA, 32 nt, Human
uuaaaaaggacaaugcugauggaagaccagac

SEQ ID NO: 532485 - RNA, 32 nt, Human
uuaaaaaggcaaaaccugaaccaccuucugca

SEQ ID NO: 532486 - RNA, 32 nt, Human
uuaaaaaggcaagaacagguaucagaagacaa

SEQ ID NO: 532487 - RNA, 32 nt, Human
uuaaaaagguauuuacacaacagaucaacauu

SEQ ID NO: 532488 - RNA, 32 nt, Human
uuaaaaauaaauguguauguguguacauauau

SEQ ID NO: 532489 - RNA, 32 nt, Human
uuaaaaauaacuucuuugcugaagugagagga

SEQ ID NO: 532490 - RNA, 32 nt, Human
uuaaaaauacaaaaauuagcuggcuguggugg

SEQ ID NO: 532491 - RNA, 32 nt, Human
uuaaaaauacaaaaauuagcugggcaugaugg

SEQ ID NO: 532492 - RNA, 32 nt, Human
uuaaaaauacaaaaauuagcugggcaugguag

SEQ ID NO: 532493 - RNA, 32 nt, Human
uuaaaaauacaaaaauuagcugggcguggugg

SEQ ID NO: 532494 - RNA, 32 nt, Human
uuaaaaauacaaaaauuagcugggguuggugg

SEQ ID NO: 532495 - RNA, 32 nt, Human
uuaaaaauacaaaaauuagcuggguguggugg

SEQ ID NO: 532496 - RNA, 32 nt, Human
uuaaaaauacaugugcauacuacacacaguau

SEQ ID NO: 532497 - RNA, 32 nt, Human
uuaaaaaucaguuucaaaaaggguguuggagg

SEQ ID NO: 532498 - RNA, 32 nt, Human
uuaaaaaugcagauguuuuacauuugauuucu

SEQ ID NO: 532499 - RNA, 32 nt, Human
uuaaaaauggaagaggaugcaggagucagauu

SEQ ID NO: 532500 - RNA, 32 nt, Human
uuaaaaauuaaagcugcaaaagaaauaaaaug

SEQ ID NO: 532501 - RNA, 32 nt, Human
uuaaaaauuacuggcuaaaaagaaggaaaaug

SEQ ID NO: 532502 - RNA, 32 nt, Human
uuaaaaauuagccaggugugguggcuugugcu

SEQ ID NO: 532503 - RNA, 32 nt, Human
uuaaaaauuagcuugguguggugcccucugcc

SEQ ID NO: 532504 - RNA, 32 nt, Human
uuaaaacaacaacugugacuguuuuaccugug

SEQ ID NO: 532505 - RNA, 32 nt, Human
uuaaaacaaugugaaacaaccugggcaacaug

SEQ ID NO: 532506 - RNA, 32 nt, Human
uuaaaacacauuugaauuuauuucucagcucu

SEQ ID NO: 532507 - RNA, 32 nt, Human
uuaaaacauauauggauguggaaagcacauau

SEQ ID NO: 532508 - RNA, 32 nt, Human
uuaaaacaugaagauuuaggucauguggcauu

SEQ ID NO: 532509 - RNA, 32 nt, Human
uuaaaacaugaggcagccauggguugggagau

SEQ ID NO: 532510 - RNA, 32 nt, Human
uuaaaacaugucuucuuuuucugauucaauac

SEQ ID NO: 532511 - RNA, 32 nt, Human
uuaaaaccaaacccugaacccuuuuaaagaac

SEQ ID NO: 532512 - RNA, 31 nt, Human
uuaaaaccaaauucagagguuggggacuuaa

SEQ ID NO: 532513 - RNA, 32 nt, Human
uuaaaaccaaauucagagguuggggacuuaaa

SEQ ID NO: 532514 - RNA, 32 nt, Human
uuaaaaccagguaccguggucacucaccugau

SEQ ID NO: 532515 - RNA, 32 nt, Human
uuaaaaccuagaggcacaaucuugacuuguca

SEQ ID NO: 532516 - RNA, 32 nt, Human
uuaaaaccucccagcugaccucagacuaggca

SEQ ID NO: 532517 - RNA, 32 nt, Human
uuaaaaccuguaucaucaaacucucucucuaa

SEQ ID NO: 532518 - RNA, 32 nt, Human
uuaaaacgaggagagagaaaaauaauggcaaa

SEQ ID NO: 532519 - RNA, 32 nt, Human
uuaaaacuacauccaacucaucauuuagccuu

SEQ ID NO: 532520 - RNA, 32 nt, Human
uuaaaacuagaacuuggcuauauugaaugugu

SEQ ID NO: 532521 - RNA, 32 nt, Human
uuaaaacuaucucuuuggcuuguguuauccag

SEQ ID NO: 532522 - RNA, 32 nt, Human
uuaaaacucccagggacucuucgcugcugcca

SEQ ID NO: 532523 - RNA, 32 nt, Human
uuaaaacuccuccuugagcacacaccuucucu

SEQ ID NO: 532524 - RNA, 32 nt, Human
uuaaaacuccuucugcgggaaggagagaagga

SEQ ID NO: 532525 - RNA, 19 nt, Human
uuaaaacucuguagucuga

SEQ ID NO: 532526 - RNA, 32 nt, Human
uuaaaacugcaacagcucuuccaggaaagaau

SEQ ID NO: 532527 - RNA, 32 nt, Human
uuaaaacugcaagucuccuacccugggauccc

SEQ ID NO: 532528 - RNA, 32 nt, Human
uuaaaacuggaagacagauucugcugauuuuc

SEQ ID NO: 532529 - RNA, 32 nt, Human
uuaaaacugggcugggagagaagauggggaag

SEQ ID NO: 532530 - RNA, 32 nt, Human
uuaaaacugucagaauucgcuguuauaauuau

SEQ ID NO: 532531 - RNA, 32 nt, Human
uuaaaacuucuuucauucccucuacagaagca

SEQ ID NO: 532532 - RNA, 32 nt, Human
uuaaaacuuuucaccccuugaagaccuuacau

SEQ ID NO: 532533 - RNA, 32 nt, Human
uuaaaagaaaaaucuuaauagcaguguuggcu

SEQ ID NO: 532534 - RNA, 32 nt, Human
uuaaaagaaagccucagagaauugcugauucu

SEQ ID NO: 532535 - RNA, 31 nt, Human
uuaaaagaacaaugacaaacacccacuuauu

SEQ ID NO: 532536 - RNA, 32 nt, Human
uuaaaagaacuccaggaaacaugaauucugga

SEQ ID NO: 532537 - RNA, 32 nt, Human
uuaaaagaaguccaaaaacaucaacacuaagg

SEQ ID NO: 532538 - RNA, 32 nt, Human
uuaaaagaagugaaacuuguagauacagcuag

SEQ ID NO: 532539 - RNA, 32 nt, Human
uuaaaagaagugaaacuuguagauauagcuag

SEQ ID NO: 532540 - RNA, 22 nt, Human
uuaaaagaauguucuuucauua

SEQ ID NO: 532541 - RNA, 32 nt, Human
uuaaaagaauuugaaaccuaauuuauauacaa

SEQ ID NO: 532542 - RNA, 32 nt, Human
uuaaaagacaaugcuauuacuacuucuuauca

SEQ ID NO: 532543 - RNA, 32 nt, Human
uuaaaagacagaggcuccaaaaugauuucagg

SEQ ID NO: 532544 - RNA, 32 nt, Human
uuaaaagacaucuuuccugcauugccaucuac

SEQ ID NO: 532545 - RNA, 31 nt, Human
uuaaaagagagaccuguauuggagaauauuu

SEQ ID NO: 532546 - RNA, 32 nt, Human
uuaaaagagccaagauuccuguuuucaguuug

SEQ ID NO: 532547 - RNA, 32 nt, Human
uuaaaagaggcaaaaauuaaaagcuuggagag

SEQ ID NO: 532548 - RNA, 32 nt, Human
uuaaaagaggccagggcgggcggagggaggcu

SEQ ID NO: 532549 - RNA, 32 nt, Human
uuaaaagaggucucuaacugaagagagaugga

SEQ ID NO: 532550 - RNA, 32 nt, Human
uuaaaagauagggaaugaagaaugcaaaaugg

SEQ ID NO: 532551 - RNA, 32 nt, Human
uuaaaagaugggcguuucccccaaugaaauac

SEQ ID NO: 532552 - RNA, 32 nt, Human
uuaaaagcacaaauacacuacauagagaaagg

SEQ ID NO: 532553 - RNA, 32 nt, Human
uuaaaagcacuuucacaccucuccucgcuucc

SEQ ID NO: 532554 - RNA, 32 nt, Human
uuaaaagcaguucaaguugacaacagcagaaa

SEQ ID NO: 532555 - RNA, 32 nt, Human
uuaaaagccuccaggauuuggugccgaacauc

SEQ ID NO: 532556 - RNA, 32 nt, Human
uuaaaagcuaucaccauuguaguagaaucauc

SEQ ID NO: 532557 - RNA, 32 nt, Human
uuaaaagcuuggagauuacuguauuuggcauu

SEQ ID NO: 532558 - RNA, 32 nt, Human
uuaaaaggcuguaaaccaugggcagauagguu

SEQ ID NO: 532559 - RNA, 32 nt, Human
uuaaaagucagaggcucucacuacacuggguc

SEQ ID NO: 532560 - RNA, 32 nt, Human
uuaaaagucagaggcuuuacuaaucuaccuau

SEQ ID NO: 532561 - RNA, 32 nt, Human
uuaaaagucuaugacaguguaacucuacaguc

SEQ ID NO: 532562 - RNA, 32 nt, Human
uuaaaagucugccuauccuggccagguguggu

SEQ ID NO: 532563 - RNA, 32 nt, Human
uuaaaagucugccuuguuuaugguggaaaauu

SEQ ID NO: 532564 - RNA, 32 nt, Human
uuaaaagugaacauaaauuauagaguggaagg

SEQ ID NO: 532565 - RNA, 32 nt, Human
uuaaaagugccauuaacaaauguaucacuagc

SEQ ID NO: 532566 - RNA, 32 nt, Human
uuaaaaguggcagaacaggaaagacgaauuaa

SEQ ID NO: 532567 - RNA, 32 nt, Human
uuaaaaguuaauagaacugucucucuguaaug

SEQ ID NO: 532568 - RNA, 32 nt, Human
uuaaaaguuagcccggugugguggcgcgcacc

SEQ ID NO: 532569 - RNA, 32 nt, Human
uuaaaaguuauuuauggccugggaaacaauuu

SEQ ID NO: 532570 - RNA, 32 nt, Human
uuaaaauaaaccugcaguuuaacagaauuuug

SEQ ID NO: 532571 - RNA, 32 nt, Human
uuaaaauaagaagugagaaaaacaauguuggg

SEQ ID NO: 532572 - RNA, 32 nt, Human
uuaaaauaagguccuucuugcccacucccucg

SEQ ID NO: 532573 - RNA, 32 nt, Human
uuaaaauacaauacccacagcaucuaacuaaa

SEQ ID NO: 532574 - RNA, 32 nt, Human
uuaaaauagcacaaauuuauuaucuucacaau

SEQ ID NO: 532575 - RNA, 32 nt, Human
uuaaaauaggcaccuuccccucccaggucugg

SEQ ID NO: 532576 - RNA, 32 nt, Human
uuaaaauaguauuuuggcuuuugaaguuauuu

SEQ ID NO: 532577 - RNA, 32 nt, Human
uuaaaauaucuggacugaguuuugccaaaugu

SEQ ID NO: 532578 - RNA, 32 nt, Human
uuaaaauauuuagcugggcacaguggugugca

SEQ ID NO: 532579 - RNA, 32 nt, Human
uuaaaauauuuauccaaaauguaguugacaga

SEQ ID NO: 532580 - RNA, 32 nt, Human
uuaaaaucacauuuuguuugagauggagaucu

SEQ ID NO: 532581 - RNA, 32 nt, Human
uuaaaaucacuuccagcuuacaucuuacacgg

SEQ ID NO: 532582 - RNA, 32 nt, Human
uuaaaaucagccaaaggaggaaaaagauacau

SEQ ID NO: 532583 - RNA, 32 nt, Human
uuagaaggguuucugucaucauggaagaggug

SEQ ID NO: 532584 - RNA, 32 nt, Human
uuagaagguacuugaggaauagagaagacugg

SEQ ID NO: 532585 - RNA, 32 nt, Human
uuagaagguuacugaaagcucugccuuccgga

SEQ ID NO: 532586 - RNA, 32 nt, Human
uuagaaguaggaggcuggacgacuucaccccc

SEQ ID NO: 532587 - RNA, 32 nt, Human
uuagaagucagauccagggagaaagugaacug

SEQ ID NO: 532588 - RNA, 32 nt, Human
uuagaaguuguccucaugaauuagcuagcauu

SEQ ID NO: 532589 - RNA, 32 nt, Human
uuagaauagacuccuggguuguuuuacaaaug

SEQ ID NO: 532590 - RNA, 32 nt, Human
uuagaauaugccacuaacacuaucugccuuuc

SEQ ID NO: 532591 - RNA, 32 nt, Human
uuagaaucgcuuuccuuccuccccuuuugccc

SEQ ID NO: 532592 - RNA, 32 nt, Human
uuagaaugagaauuaaagagaaaacaaaagaa

SEQ ID NO: 532593 - RNA, 32 nt, Human
uuagaauggcuugucccaucagcagaugaaug

SEQ ID NO: 532594 - RNA, 32 nt, Human
uuagaauggugcuucucagcucugcuuaaaug

SEQ ID NO: 532595 - RNA, 32 nt, Human
uuagaauguaugcacacauccauggacacuca

SEQ ID NO: 532596 - RNA, 32 nt, Human
uuagaaugugauuuuuauuccuuuuuauuucu

SEQ ID NO: 532597 - RNA, 32 nt, Human
uuagaaugugauuuuuguuccuuuuuauuuau

SEQ ID NO: 532598 - RNA, 32 nt, Human
uuagaaugugauuuuuguuccuuuuuauuucu

SEQ ID NO: 532599 - RNA, 32 nt, Human
uuagaauguugaggcaguuucccagagaaaca

SEQ ID NO: 532600 - RNA, 32 nt, Human
uuagaauugacaacauaaacuacuuuugcuuu

SEQ ID NO: 532601 - RNA, 32 nt, Human
uuagaauugcccagugcugccagagugaguga

SEQ ID NO: 532602 - RNA, 32 nt, Human
uuagaauuggauuugaagaacucgacuuuaug

SEQ ID NO: 532603 - RNA, 32 nt, Human
uuagaauuugccuguaaaaugaauucuaaaaa

SEQ ID NO: 532604 - RNA, 32 nt, Human
uuagaauuuugcaaaugcuggaauucugccag

SEQ ID NO: 532605 - RNA, 32 nt, Human
uuagacaacugaaacccacugcccuguaaccc

SEQ ID NO: 532606 - RNA, 32 nt, Human
uuagacaagccuuucacaacauuucaucaauu

SEQ ID NO: 532607 - RNA, 32 nt, Human
uuagacaaggucuugcucugucccucaggcug

SEQ ID NO: 532608 - RNA, 32 nt, Human
uuagacaaugauuuuuauuauuauccugcuau

SEQ ID NO: 532609 - RNA, 32 nt, Human
uuagacacccacaaaggcugcucuuuagccuc

SEQ ID NO: 532610 - RNA, 32 nt, Human
uuagacaccugccucugcuccugcccaacgcc

SEQ ID NO: 532611 - RNA, 32 nt, Human
uuagacacuggcccaacuccaggcguuuccuu

SEQ ID NO: 532612 - RNA, 32 nt, Human
uuagacagagucucgcucugucgcccaggcug

SEQ ID NO: 532613 - RNA, 32 nt, Human
uuagacagccaaaggcuggcgagagucuggcc

SEQ ID NO: 532614 - RNA, 32 nt, Human
uuagacagccugauacaggccuguagccucuu

SEQ ID NO: 532615 - RNA, 32 nt, Human
uuagacagccuggugauggaggaugaagaaac

SEQ ID NO: 532616 - RNA, 32 nt, Human
uuagacagggucuugcuccguugcccagguug

SEQ ID NO: 532617 - RNA, 32 nt, Human
uuagacaggugaggaaacuggggcacagagag

SEQ ID NO: 532618 - RNA, 20 nt, Human
uuagacauuguauaaaauau

SEQ ID NO: 532619 - RNA, 22 nt, Human
uuagacauuuaucaacuguuga

SEQ ID NO: 532620 - RNA, 32 nt, Human
uuagaccaagggcacagauugugcuucuguac

SEQ ID NO: 532621 - RNA, 31 nt, Human
uuagaccacagagagcuggcauucacucaaa

SEQ ID NO: 532622 - RNA, 32 nt, Human
uuagaccaccuaagaugccacuuugaauucuc

SEQ ID NO: 532623 - RNA, 32 nt, Human
uuagaccacuuguaaagauuacuccaacccag

SEQ ID NO: 532624 - RNA, 32 nt, Human
uuagaccagguaguuuguugcauugcagguaa

SEQ ID NO: 532625 - RNA, 32 nt, Human
uuagaccauacagagauguagaaagaacauaa

SEQ ID NO: 532626 - RNA, 32 nt, Human
uuagacccaagcucucuuucugacuuuccuua

SEQ ID NO: 532627 - RNA, 32 nt, Human
uuagacccaaggacccgauuccugggcuagga

SEQ ID NO: 532628 - RNA, 32 nt, Human
uuagacccaguaucuacuucugugccacaaaa

SEQ ID NO: 532629 - RNA, 32 nt, Human
uuagaccuacaugcagcccaaccucuccuucu

SEQ ID NO: 532630 - RNA, 32 nt, Human
uuagaccucuagacugguucauucuacguauc

SEQ ID NO: 532631 - RNA, 32 nt, Human
uuagaccucuccccauucugcuagcaacauac

SEQ ID NO: 532632 - RNA, 32 nt, Human
uuagaccugugucuuacacauuucucagagua

SEQ ID NO: 532633 - RNA, 32 nt, Human
uuagaccuguucuggcugaagggcuaucucug

SEQ ID NO: 532634 - RNA, 32 nt, Human
uuagaccuuaaaggagcuccaccaaaggucuc

SEQ ID NO: 532635 - RNA, 32 nt, Human
uuagacgagucauggauuuguacugaguauuu

SEQ ID NO: 532636 - RNA, 21 nt, Human
uuagacgauguguaauguuaa

SEQ ID NO: 532637 - RNA, 32 nt, Human
uuagacggaaagggaaacugaggcucaggaga

SEQ ID NO: 532638 - RNA, 32 nt, Human
uuagacggaggcaggaguuucguuagaaagcg

SEQ ID NO: 532639 - RNA, 32 nt, Human
uuagacggaguuuugcucuuuguugcccaggc

SEQ ID NO: 532640 - RNA, 32 nt, Human
uuagacggucucaaucuaaaagcacuucaagg

SEQ ID NO: 532641 - RNA, 32 nt, Human
uuagacuacaaucugugcagacagcauggaca

SEQ ID NO: 532642 - RNA, 32 nt, Human
uuagacucaaaacccgcaggagaaacaggucc

SEQ ID NO: 532643 - RNA, 32 nt, Human
uuagacuccaaaaggauuauaaaacucccaaa

SEQ ID NO: 532644 - RNA, 32 nt, Human
uuagacuccaucccucaacuucucccauccuc

SEQ ID NO: 532645 - RNA, 32 nt, Human
uuagacucccacagaggggacugucuguauca

SEQ ID NO: 532646 - RNA, 32 nt, Human
uuagacuccucaccauccuuaaguucagugac

SEQ ID NO: 532647 - RNA, 32 nt, Human
uuagacucuaucaugggcccccaugaagcucc

SEQ ID NO: 532648 - RNA, 32 nt, Human
uuagacucuccacagcauucaugucaauaugg

SEQ ID NO: 532649 - RNA, 32 nt, Human
uuagacucuuagaaauaaaaguagaagaaaga

SEQ ID NO: 532650 - RNA, 32 nt, Human
uuagacuuaagacuguaaggcagcaguguuag

SEQ ID NO: 532651 - RNA, 32 nt, Human
uuagacuuaccucccccaugcagcagacuggg

SEQ ID NO: 532652 - RNA, 32 nt, Human
uuagacuuauaggugaugcaagcaucuaagag

SEQ ID NO: 532653 - RNA, 32 nt, Human
uuagacuuaugauagaaguucauuucagccuc

SEQ ID NO: 532654 - RNA, 32 nt, Human
uuagacuucuagguaaugcaagcaucuaagag

SEQ ID NO: 532655 - RNA, 32 nt, Human
uuagacuucugguccccagaacggagagagaa

SEQ ID NO: 532656 - RNA, 32 nt, Human
uuagacuugaugcuauguugauuaauauuuaa

SEQ ID NO: 532657 - RNA, 32 nt, Human
uuagacuuuuaacacgauggccauaaccugac

SEQ ID NO: 532658 - RNA, 32 nt, Human
uuagagaaacaacaugguuccaagaaggaggg

SEQ ID NO: 532659 - RNA, 32 nt, Human
uuagagaaaucucggcggucaggaggcccggg

SEQ ID NO: 532660 - RNA, 32 nt, Human
uuagagaacagccugguuaacauggugaaaca

SEQ ID NO: 532661 - RNA, 32 nt, Human
uuagagaagaaagaacaggcuuugaagaagag

SEQ ID NO: 532662 - RNA, 32 nt, Human
uuagagaagugacauggccuugaggagauuca

SEQ ID NO: 532663 - RNA, 32 nt, Human
uuagagaaguugcagaagcagugaagccacua

SEQ ID NO: 532664 - RNA, 22 nt, Human
uuagagaauaugcaaauauuga

SEQ ID NO: 532665 - RNA, 32 nt, Human
uuagagaaucaagcugacacaggccagagaau

SEQ ID NO: 532666 - RNA, 31 nt, Human
uuagagacagagagagaaaaaggcugaaaug

SEQ ID NO: 532667 - RNA, 32 nt, Human
uuagagacagcaucggugucugcugcuguguc

SEQ ID NO: 532668 - RNA, 32 nt, Human
uuagagacaggcacaugggcagcucuguuccc

SEQ ID NO: 532669 - RNA, 24 nt, Human
uuagagaccacccugggcaaugua

SEQ ID NO: 532670 - RNA, 32 nt, Human
uuagagaccagcccagccuggucaacauggca

SEQ ID NO: 532671 - RNA, 32 nt, Human
uuagagaccagccuggccaacaaggcaaaacc

SEQ ID NO: 532672 - RNA, 24 nt, Human
uuagagaccagccugggaaacaua

SEQ ID NO: 532673 - RNA, 32 nt, Human
uuagagaccagccugggaaacauagcgaaacc

SEQ ID NO: 532674 - RNA, 24 nt, Human
uuagagaccagccugggcaacaug

SEQ ID NO: 532675 - RNA, 32 nt, Human
uuagagaccagccugggcaacaugaugugaaa

SEQ ID NO: 532676 - RNA, 32 nt, Human
uuagagaccagccugggcaacauggugaaauc

SEQ ID NO: 532677 - RNA, 32 nt, Human
uuagagaccagccugggcaacguauugagacc

SEQ ID NO: 532678 - RNA, 32 nt, Human
uuagagaccagccugggccaacguggugaaac

SEQ ID NO: 532679 - RNA, 32 nt, Human
uuagagaccagccuguccaacguggugaaacc

SEQ ID NO: 532680 - RNA, 32 nt, Human
uuagagaccccgagguagggguggggagaugc

SEQ ID NO: 532681 - RNA, 32 nt, Human
uuagagacugcuccuauaauugaggaaucagc

SEQ ID NO: 532682 - RNA, 32 nt, Human
uuagagagagaacacuuagucuugccugucaa

SEQ ID NO: 532683 - RNA, 32 nt, Human
uuagagagcagccugggcaacauagcaagaac

SEQ ID NO: 532684 - RNA, 32 nt, Human
uuagagagcuugucuuucaaggccagguuccc

SEQ ID NO: 532685 - RNA, 32 nt, Human
uuagagaggaggaggaaagggggagaggaaau

SEQ ID NO: 532686 - RNA, 32 nt, Human
uuagagaggucccccaaagaaaccacugguuu

SEQ ID NO: 532687 - RNA, 32 nt, Human
uuagagaguucugcacaguacuguccuccaga

SEQ ID NO: 532688 - RNA, 32 nt, Human
uuagagauaccuccccuccuucugcucagcug

SEQ ID NO: 532689 - RNA, 32 nt, Human
uuagagaucaaagaagucagagagauuggaag

SEQ ID NO: 532690 - RNA, 32 nt, Human
uuagagaucccagucugguauccucuggagag

SEQ ID NO: 532691 - RNA, 32 nt, Human
uuagagaucuuagauccuaguuuuugauguug

SEQ ID NO: 532692 - RNA, 21 nt, Human
uuagagaugaaaguagcccac

SEQ ID NO: 532693 - RNA, 32 nt, Human
uuagagauuauguacacaagggcaugggcuca

SEQ ID NO: 532694 - RNA, 32 nt, Human
uuagagcaacuuguacauuugaccucuuguua

SEQ ID NO: 532695 - RNA, 32 nt, Human
uuagagcaaucaucucugccacugacccagug

SEQ ID NO: 532696 - RNA, 32 nt, Human
uuagagcagcacaaccggacuaacacagugac

SEQ ID NO: 532697 - RNA, 32 nt, Human
uuagagccucagcugcuaauauuguugagugc

SEQ ID NO: 532698 - RNA, 32 nt, Human
uuagagcuaggaguuugagaccagccugggca

SEQ ID NO: 532699 - RNA, 32 nt, Human
uuagagcuuaagacacaccugccuucauuuca

SEQ ID NO: 532700 - RNA, 32 nt, Human
uuagagcuucagucuuuggagcacacagggcc

SEQ ID NO: 532701 - RNA, 32 nt, Human
uuagagcuuccagagagcauagcugcuuccau

SEQ ID NO: 532702 - RNA, 32 nt, Human
uuagagcuucggcuugaccucugugauaaaua

SEQ ID NO: 532703 - RNA, 23 nt, Human
uuagagcuuucauuugaucugua

SEQ ID NO: 532704 - RNA, 32 nt, Human
uuagaggaggaggaggaggaggaagaggugga

SEQ ID NO: 532705 - RNA, 31 nt, Human
uuagaggagucaggagaaaaagucauuguua

SEQ ID NO: 532706 - RNA, 32 nt, Human
uuagaggcaauauuuucuacuugcaaucaauu

SEQ ID NO: 532707 - RNA, 32 nt, Human
uuagaggcacuugagcaaggcccccacauccc

SEQ ID NO: 532708 - RNA, 32 nt, Human
uuagaggccaggaccacaguuaggauuggguu

SEQ ID NO: 532709 - RNA, 32 nt, Human
uuagaggcuggaccagcauuguugggcaagga

SEQ ID NO: 532710 - RNA, 32 nt, Human
uuagagggagcugggaaggaaggaagggggcg

SEQ ID NO: 532711 - RNA, 32 nt, Human
uuagaggggaaugaaccauggcaccuuugaga

SEQ ID NO: 532712 - RNA, 32 nt, Human
uuagaggggccaggcagcggggcagggacagg

SEQ ID NO: 532713 - RNA, 32 nt, Human
uuagagggggucucacuuuguugcccaggcug

SEQ ID NO: 532714 - RNA, 32 nt, Human
uuagagguaugggccagagaggacugggucag

SEQ ID NO: 532715 - RNA, 32 nt, Human
uuagaggugagcuggggccggagaagccacgg

SEQ ID NO: 532716 - RNA, 32 nt, Human
uuagagguugcagugagguaugaucaugccau

SEQ ID NO: 532717 - RNA, 32 nt, Human
uuagaguacaaaacauguucucccugcagucu

SEQ ID NO: 532718 - RNA, 32 nt, Human
uuagaguagagaagaaaaguaggggugcaaua

SEQ ID NO: 532719 - RNA, 32 nt, Human
uuagagucaaaggcagaggggcuuccaggccc

SEQ ID NO: 532720 - RNA, 32 nt, Human
uuagagucaaggccuggauuucaugccacuaa

SEQ ID NO: 532721 - RNA, 32 nt, Human
uuagaguccagccuggccaacauggugaaacc

SEQ ID NO: 532722 - RNA, 32 nt, Human
uuagaguccaguucuagagacuccucagccuc

SEQ ID NO: 532723 - RNA, 32 nt, Human
uuagaguccccagaaaggaaugcagccuugcu

SEQ ID NO: 532724 - RNA, 32 nt, Human
uuagaguccgaccucuggaaauguccacaccu

SEQ ID NO: 532725 - RNA, 32 nt, Human
uuagaguccgaccucuggaaauucggguggcc

SEQ ID NO: 532726 - RNA, 32 nt, Human
uuagaguccucccaggaucccuccaaccuacc

SEQ ID NO: 532727 - RNA, 32 nt, Human
uuagagucucauaaggagcacgcaaccuagau

SEQ ID NO: 532728 - RNA, 32 nt, Human
uuagagugcauccuuuguuuaaagugaaaugg

SEQ ID NO: 532729 - RNA, 32 nt, Human
uuagaguggaaggacugauugagaauguucca

SEQ ID NO: 532730 - RNA, 32 nt, Human
uuagaguggaguuugugaguaaaagaggagcc

SEQ ID NO: 532731 - RNA, 32 nt, Human
uuagaguggcuuagugugacacacaggcaucu

SEQ ID NO: 532732 - RNA, 32 nt, Human
uuagaguggggagugggcuucuuccuccaaga

SEQ ID NO: 532733 - RNA, 32 nt, Human
uuagagugguggcacugagaaaagaauguaag

SEQ ID NO: 532734 - RNA, 32 nt, Human
uuagaguguaguucaacucauuugucacaugg

SEQ ID NO: 532735 - RNA, 32 nt, Human
uuagaguguauaaaauucugucuuucauuucc

SEQ ID NO: 532736 - RNA, 32 nt, Human
uuagaguuaagaauucucuagcaaacaacaga

SEQ ID NO: 532737 - RNA, 32 nt, Human
uuagaguuccaugaacaccauaccuuugcuac

SEQ ID NO: 532738 - RNA, 32 nt, Human
uuagaguugcuaaugacuguccuugaaauuau

SEQ ID NO: 532739 - RNA, 32 nt, Human
uuagaguuuaaucucaugcucuaccuuuauuu

SEQ ID NO: 532740 - RNA, 32 nt, Human
uuagauaacuuagauauaguuucuugauagga

SEQ ID NO: 532741 - RNA, 32 nt, Human
uuagauaccauccugagggucugaaauuaaac

SEQ ID NO: 532742 - RNA, 32 nt, Human
uuagauaccuugaaaggcaggaagggaagcgu

SEQ ID NO: 532743 - RNA, 32 nt, Human
uuagauacucugugaggugcaagacuucaggg

SEQ ID NO: 532744 - RNA, 26 nt, Human
uuagauacuugcaauuuaaauguuaa

SEQ ID NO: 532745 - RNA, 32 nt, Human
uuagauaucaugcaaauuucaugaccaguaaa

SEQ ID NO: 532746 - RNA, 32 nt, Human
uuagauauugaaucucguuacaggguuauuua

SEQ ID NO: 532747 - RNA, 23 nt, Human
uuagauauuguaucaaucuuuag

SEQ ID NO: 532748 - RNA, 32 nt, Human
uuagaucaucuaaaucagguaugagugaaacu

SEQ ID NO: 532749 - RNA, 32 nt, Human
uuagaucaugccaccaugccacugcacuccag

SEQ ID NO: 532750 - RNA, 32 nt, Human
uuagaucaugccacugcacuccagccuaugug

SEQ ID NO: 532751 - RNA, 32 nt, Human
uuagaucauuagcucagugaccuccuaggguu

SEQ ID NO: 532752 - RNA, 32 nt, Human
uuagauccucaccauuucugcucucaaauuga

SEQ ID NO: 532753 - RNA, 32 nt, Human
uuagaucgaacuguaacauuauuccaaucaca

SEQ ID NO: 532754 - RNA, 32 nt, Human
uuagaucuccaggaguuggggcuccagaaccu

SEQ ID NO: 532755 - RNA, 32 nt, Human
uuagaugaaaucugguaggagaacauagauca

SEQ ID NO: 532756 - RNA, 32 nt, Human
uuagaugagaauucacuuguucugucaguaau

SEQ ID NO: 532757 - RNA, 32 nt, Human
uuagaugagcuucuuuccuccauuucaccugg

SEQ ID NO: 532758 - RNA, 32 nt, Human
uuagaugaggcuauugccuugaugacagcugu

SEQ ID NO: 532759 - RNA, 32 nt, Human
uuagaugagguguugcuguguugcccaagcug

SEQ ID NO: 532760 - RNA, 32 nt, Human
uuagaugauucacuuagaaaacaaauaaacuu

SEQ ID NO: 532761 - RNA, 32 nt, Human
uuagaugauucacuuuuugccccuagggauga

SEQ ID NO: 532762 - RNA, 32 nt, Human
uuagaugcucauaaggagugcacaaccgccgg

SEQ ID NO: 532763 - RNA, 32 nt, Human
uuagauggagucucgcucugucacccagacug

SEQ ID NO: 532764 - RNA, 32 nt, Human
uuagauggagucuugcuccgucgcccaggcug

SEQ ID NO: 532765 - RNA, 32 nt, Human
uuagauggagucuugcucugucgcccacccag

SEQ ID NO: 532766 - RNA, 32 nt, Human
uuagaugggagaaaccucuagagagaguaaaa

SEQ ID NO: 532767 - RNA, 32 nt, Human
uuagauguccucuuggagaaaauaacaagagu

SEQ ID NO: 532768 - RNA, 32 nt, Human
uuagaugugcaaccuguggcucaggggagcaa

SEQ ID NO: 532769 - RNA, 32 nt, Human
uuagauguggguggguguggccgccucugccc

SEQ ID NO: 532770 - RNA, 32 nt, Human
uuagauguguguuucaggcuuggaguguauga

SEQ ID NO: 532771 - RNA, 32 nt, Human
uuagauguuuacugcugaaguaggucagaaau

SEQ ID NO: 532772 - RNA, 32 nt, Human
uuagauuaaccucaccaaaugaagcuuuuucu

SEQ ID NO: 532773 - RNA, 32 nt, Human
uuagauuaauucaacuccugagguccugaagg

SEQ ID NO: 532774 - RNA, 32 nt, Human
uuagauuauuaucacaccacuguggacuguuc

SEQ ID NO: 532775 - RNA, 32 nt, Human
uuagauuccagagacaucagcauggcucaaag

SEQ ID NO: 532776 - RNA, 32 nt, Human
uuagauuccuccauccaugacccccugccccu

SEQ ID NO: 532777 - RNA, 32 nt, Human
uuagauuccuuucccuucucuccaguucuccu

SEQ ID NO: 532778 - RNA, 32 nt, Human
uuagauucucauaaggagcaaacaaccaagau

SEQ ID NO: 532779 - RNA, 32 nt, Human
uuagauucucauaaggagugcacaaucuagau

SEQ ID NO: 532780 - RNA, 32 nt, Human
uuagauucucauaaggagugugcaaucuagau

SEQ ID NO: 532781 - RNA, 32 nt, Human
uuagauucucauaaggaguucacagccuagau

SEQ ID NO: 532782 - RNA, 32 nt, Human
uuagauucuuuugcuaggugggagauuguuau

SEQ ID NO: 532783 - RNA, 32 nt, Human
uuagauugcucuucuagaaccauggcuagaag

SEQ ID NO: 532784 - RNA, 32 nt, Human
uuagauugggagcuccuugagggcagaguacg

SEQ ID NO: 532785 - RNA, 32 nt, Human
uuagauuucacucagcauuuaguagguccagu

SEQ ID NO: 532786 - RNA, 32 nt, Human
uuagauuuguggagucuuugugcugcuucugg

SEQ ID NO: 532787 - RNA, 32 nt, Human
uuagauuuuaucacucucugcuaagacaauau

SEQ ID NO: 532788 - RNA, 32 nt, Human
uuagauuuucaaggaugcucuucauccagcug

SEQ ID NO: 532789 - RNA, 32 nt, Human
uuagauuuuugaaagaaaacccuuugguuuca

SEQ ID NO: 532790 - RNA, 32 nt, Human
uuagcaaacugaugcugaggaugauugaggug

SEQ ID NO: 532791 - RNA, 32 nt, Human
uuagcaaagcagguggcccacagugaccucca

SEQ ID NO: 532792 - RNA, 32 nt, Human
uuagcaaaggggcaauggggugccuacuaugu

SEQ ID NO: 532793 - RNA, 23 nt, Human
uuagcaaaugauugauucucccu

SEQ ID NO: 532794 - RNA, 32 nt, Human
uuagcaaaugugccauuuucacacaacuucuc

SEQ ID NO: 532795 - RNA, 19 nt, Human
uuagcaaauugauuuaccu

SEQ ID NO: 532796 - RNA, 32 nt, Human
uuagcaaccacagagucagugaccucgucugu

SEQ ID NO: 532797 - RNA, 32 nt, Human
uuagcaaccuucauuccaucugccuccuucau

SEQ ID NO: 532798 - RNA, 32 nt, Human
uuagcaacuguuacuucaaccaucuagguuga

SEQ ID NO: 532799 - RNA, 32 nt, Human
uuagcaagaaagucuuaauuugugucacgauu

SEQ ID NO: 532800 - RNA, 32 nt, Human
uuagcaagaccacgaacccacagggaggaaca

SEQ ID NO: 532801 - RNA, 32 nt, Human
uuagcaagcagguuucacugcuucauuagaag

SEQ ID NO: 532802 - RNA, 32 nt, Human
uuagcaagcgugugugacagagaguggggaaa

SEQ ID NO: 532803 - RNA, 32 nt, Human
uuagcaagcuccuggagucugaugcuuuugca

SEQ ID NO: 532804 - RNA, 32 nt, Human
uuagcaaggaaaguacaaaauaguuuauguag

SEQ ID NO: 532805 - RNA, 32 nt, Human
uuagcaaggcauucagagccuuucaaauccca

SEQ ID NO: 532806 - RNA, 21 nt, Human
uuagcaagucugguguuuuaa

SEQ ID NO: 532807 - RNA, 32 nt, Human
uuagcaauagcuccacuuugggugggggagau

SEQ ID NO: 532808 - RNA, 32 nt, Human
uuagcaaugaggaggaaaugugaucuggcugu

SEQ ID NO: 532809 - RNA, 32 nt, Human
uuagcaauuggcuguugaugugccucagcugu

SEQ ID NO: 532810 - RNA, 32 nt, Human
uuagcaauuuccauauacuauauuguggaaaa

SEQ ID NO: 532811 - RNA, 32 nt, Human
uuagcacaaguuagggaggaagaggcaggcga

SEQ ID NO: 532812 - RNA, 32 nt, Human
uuagcacaggauccuucccuggaacaucagca

SEQ ID NO: 532813 - RNA, 32 nt, Human
uuagcacaucacugcacacacaguauucugaa

SEQ ID NO: 532814 - RNA, 32 nt, Human
uuagcaccauacuugcuauuugcaauuaaugu

SEQ ID NO: 532815 - RNA, 32 nt, Human
uuagcaccuggaccagcagcugcugugcucga

SEQ ID NO: 532816 - RNA, 32 nt, Human
uuagcacguuuaccauacguuuaaaauccauu

SEQ ID NO: 532817 - RNA, 32 nt, Human
uuagcacucuagcugcccacuccagggcaggg

SEQ ID NO: 532818 - RNA, 32 nt, Human
uuagcacuggaagcuuuugcucgcaguuugcu

SEQ ID NO: 532819 - RNA, 32 nt, Human
uuagcacuuaagaucagauucaagagaauaua

SEQ ID NO: 532820 - RNA, 32 nt, Human
uuagcagaacagaacccagggccagacugugu

SEQ ID NO: 532821 - RNA, 32 nt, Human
uuagcagaaggugagcaagaaguuggagacug

SEQ ID NO: 532822 - RNA, 32 nt, Human
uuagcagacaacaggugaaaccaacaggguuu

SEQ ID NO: 532823 - RNA, 32 nt, Human
uuagcagacagcauuuucagacagcauuuuca

SEQ ID NO: 532824 - RNA, 32 nt, Human
uuagcagacugguguguguggaucugcagugc

SEQ ID NO: 532825 - RNA, 32 nt, Human
uuagcagagacaccucguuaagcuccgggaug

SEQ ID NO: 532826 - RNA, 32 nt, Human
uuagcagagacaggguuucaccauguuggcca

SEQ ID NO: 532827 - RNA, 32 nt, Human
uuagcagagacaggguuucaccguguuggcca

SEQ ID NO: 532828 - RNA, 32 nt, Human
uuagcagcagagggcaguuccccagcuugaug

SEQ ID NO: 532829 - RNA, 32 nt, Human
uuagcagcagcguucccugccuccugcaggau

SEQ ID NO: 532830 - RNA, 32 nt, Human
uuagcagcccuggaugguggccagaaauaaag

SEQ ID NO: 532831 - RNA, 18 nt, Human
uuagcagccucagcacug

SEQ ID NO: 532832 - RNA, 32 nt, Human
uuagcagcgaugacacagcaaggaugacucag

SEQ ID NO: 532833 - RNA, 23 nt, Human
uuagcagcuaguaacuucacuua

SEQ ID NO: 532834 - RNA, 32 nt, Human
uuagcagcuaucucucagugaacugugagggu

SEQ ID NO: 532835 - RNA, 32 nt, Human
uuagcagcucugacuaacaggcugcaaagugc

SEQ ID NO: 532836 - RNA, 32 nt, Human
uuagcaggaagcuuccugaagggccgagcggg

SEQ ID NO: 532837 - RNA, 32 nt, Human
uuagcaggagagaaagcaaggaguugucagga

SEQ ID NO: 532838 - RNA, 32 nt, Human
uuagcaggagcagauuuuucccagaagcugcu

SEQ ID NO: 532839 - RNA, 32 nt, Human
uuagcagggaggaggaagaggagaggaggaag

SEQ ID NO: 532840 - RNA, 32 nt, Human
uuagcagguuggugagagaagcuccccugagc

SEQ ID NO: 532841 - RNA, 32 nt, Human
uuagcaguccuggaaguugaagguggagaugg

SEQ ID NO: 532842 - RNA, 32 nt, Human
uuagcaguggugaggccggaguacuccacacg

SEQ ID NO: 532843 - RNA, 32 nt, Human
uuagcaguuuuuaaaaacuaguuguuaaauuu

SEQ ID NO: 532844 - RNA, 32 nt, Human
uuagcauaaagugcuugcaauuucucuccaca

SEQ ID NO: 532845 - RNA, 32 nt, Human
uuagcauaacccuuccucaggaagagugagau

SEQ ID NO: 532846 - RNA, 32 nt, Human
uuagcauaauggcagaaccuguuucuccacug

SEQ ID NO: 532847 - RNA, 32 nt, Human
uuagcauaauugcagugcuaaugaauaucgga

SEQ ID NO: 532848 - RNA, 32 nt, Human
uuagcauagggcucagggcacacguugccacc

SEQ ID NO: 532849 - RNA, 32 nt, Human
uuagcauaguaagcagauauuucuacuuuugu

SEQ ID NO: 532850 - RNA, 32 nt, Human
uuagcauagugccuggugagugaugucccaau

SEQ ID NO: 532851 - RNA, 32 nt, Human
uuagcaucauuugaggccuggaaggcuaugaa

SEQ ID NO: 532852 - RNA, 32 nt, Human
uuagcaucuucuuuaccuccaguguuccugcc

SEQ ID NO: 532853 - RNA, 32 nt, Human
uuagcauggauugagccagaucuguuccuuac

SEQ ID NO: 532854 - RNA, 32 nt, Human
uuagcaugggacauagucaguguuugaagugc

SEQ ID NO: 532855 - RNA, 32 nt, Human
uuagcauucaacuuaagucaagaaauacuuau

SEQ ID NO: 532856 - RNA, 32 nt, Human
uuagcauuugagagaagaggccaggggccuug

SEQ ID NO: 532857 - RNA, 25 nt, Human
uuagcauuugcauguguaauauuaa

SEQ ID NO: 532858 - RNA, 32 nt, Human
uuagccaacucucaaaccuuacuaaacacaag

SEQ ID NO: 532859 - RNA, 32 nt, Human
uuagccaagcuccucaaccuucucccaggccc

SEQ ID NO: 532860 - RNA, 32 nt, Human
uuagccaauauggugaaaccccgucucuacua

SEQ ID NO: 532861 - RNA, 32 nt, Human
uuagccaaugacaacucacucuccccuacucc

SEQ ID NO: 532862 - RNA, 32 nt, Human
uuagccacacuucucccuucaggggcuucgga

SEQ ID NO: 532863 - RNA, 32 nt, Human
uuagccacagcuguuuuaagacuucugaucuc

SEQ ID NO: 532864 - RNA, 32 nt, Human
uuagccacaggcagaauagcuuucgaugaccc

SEQ ID NO: 532865 - RNA, 32 nt, Human
uuagccacugaacuucaguggaggguggugag

SEQ ID NO: 532866 - RNA, 32 nt, Human
uuagccagacuuguuuugcuaucuuauaagca

SEQ ID NO: 532867 - RNA, 32 nt, Human
uuagccagcugccucugcuguaguacauggcc

SEQ ID NO: 532868 - RNA, 32 nt, Human
uuagccaggugugguggcaagugccuuuaauc

SEQ ID NO: 532869 - RNA, 32 nt, Human
uuagccagugacugcagagcagggauaccaag

SEQ ID NO: 532870 - RNA, 32 nt, Human
uuagccagugauuaaggaauccauuauguaac

SEQ ID NO: 532871 - RNA, 32 nt, Human
uuagccaguucuauaauaucuuccugugauuu

SEQ ID NO: 532872 - RNA, 32 nt, Human
uuagccaguugcucugccacagacauagacaa

SEQ ID NO: 532873 - RNA, 32 nt, Human
uuagccauaagacauguuucaagugaaucgaa

SEQ ID NO: 532874 - RNA, 32 nt, Human
uuagcccaagugguacagugaauuugcuuuaa

SEQ ID NO: 532875 - RNA, 32 nt, Human
uuagcccaggaguucaagaucagcuugugcaa

SEQ ID NO: 532876 - RNA, 32 nt, Human
uuagcccaugaggaggaugugaccgggacuga

SEQ ID NO: 532877 - RNA, 32 nt, Human
uuagccccaaagcucuucuaguucucaccugg

SEQ ID NO: 532878 - RNA, 21 nt, Human
uuagccccaacucugugcuca

SEQ ID NO: 532879 - RNA, 32 nt, Human
uuagccccaagaagguucuggaaagcuccagg

SEQ ID NO: 532880 - RNA, 32 nt, Human
uuagccccaguuccugcacgcuccagggaacg

SEQ ID NO: 532881 - RNA, 32 nt, Human
uuagcccccacccugccuggugugcagcuaac

SEQ ID NO: 532882 - RNA, 22 nt, Human
uuagccccuccaucuagucuca

SEQ ID NO: 532883 - RNA, 26 nt, Human
uuagccccuuccuuucucugggcuca

SEQ ID NO: 532884 - RNA, 32 nt, Human
uuagcccgggacccgaacccagccucuccccu

SEQ ID NO: 532885 - RNA, 32 nt, Human
uuagcccguccgggggcaccgucacggucagg

SEQ ID NO: 532886 - RNA, 32 nt, Human
uuagcccuccagcauuuaaaacaugauaaauu

SEQ ID NO: 532887 - RNA, 32 nt, Human
uuagcccucuacuguugaccaaucaccaaaug

SEQ ID NO: 532888 - RNA, 32 nt, Human
uuagcccucugaguacuuugaagcacuuuugc

SEQ ID NO: 532889 - RNA, 20 nt, Human
uuagcccugagccugcacuu

SEQ ID NO: 532890 - RNA, 32 nt, Human
uuagcccugagccugcacuuccuguucaggug

SEQ ID NO: 532891 - RNA, 32 nt, Human
uuagcccugcuaaacuauguacagaggaaacu

SEQ ID NO: 532892 - RNA, 32 nt, Human
uuagcccugggccaccuccuccaguucuuccu

SEQ ID NO: 532893 - RNA, 32 nt, Human
uuagcccuguugcccauguaugcagaugggag

SEQ ID NO: 532894 - RNA, 32 nt, Human
uuagcccuuaacccuaaggcucagggaaauac

SEQ ID NO: 532895 - RNA, 32 nt, Human
uuagcccuuguaauccuagcacuuugggaggc

SEQ ID NO: 532896 - RNA, 32 nt, Human
uuagcccuuucccagagacugauaaacagggg

SEQ ID NO: 532897 - RNA, 32 nt, Human
uuagccgagauggcuggaucaucugaggucag

SEQ ID NO: 532898 - RNA, 32 nt, Human
uuagccgggugugggcugggcgcgguggcuca

SEQ ID NO: 532899 - RNA, 32 nt, Human
uuagccgugguggcaggugccuguaaucccag

SEQ ID NO: 532900 - RNA, 32 nt, Human
uuagccuaguacugcuguacuggccuguaugu

SEQ ID NO: 532901 - RNA, 32 nt, Human
uuagccucaaaagcauguaguaccaagcacuu

SEQ ID NO: 532902 - RNA, 32 nt, Human
uuagccucccaaaaugcugggauuacagguau

SEQ ID NO: 532903 - RNA, 32 nt, Human
uuagccucccaaaguacugggauuacagguga

SEQ ID NO: 532904 - RNA, 32 nt, Human
uuagccucccaaagugcugggaugacaggcgu

SEQ ID NO: 532905 - RNA, 32 nt, Human
uuagccucccaaagugcugggauuacaagcau

SEQ ID NO: 532906 - RNA, 32 nt, Human
uuagccucccaaagugcugggauuacagcugu

SEQ ID NO: 532907 - RNA, 32 nt, Human
uuagccucccaaagugcugggauuacaggaug

SEQ ID NO: 532908 - RNA, 32 nt, Human
uuagccucccaaagugcugggauuacaggcau

SEQ ID NO: 532909 - RNA, 32 nt, Human
uuagccucccaaagugcugggauuacaggcgc

SEQ ID NO: 532910 - RNA, 32 nt, Human
uuagccucccaaagugcugggauuacaggcgu

SEQ ID NO: 532911 - RNA, 32 nt, Human
uuagccucccaaagugcugggauuagguguga

SEQ ID NO: 532912 - RNA, 32 nt, Human
uuagccucccaaaguguugggauuauaagcgu

SEQ ID NO: 532913 - RNA, 32 nt, Human
uuagccucccaaguagcugggauuacaggcag

SEQ ID NO: 532914 - RNA, 32 nt, Human
uuagccucccaaguagcugggauuacaggcau

SEQ ID NO: 532915 - RNA, 32 nt, Human
uuagccucccaaguagcugggauuacaggcgu

SEQ ID NO: 532916 - RNA, 32 nt, Human
uuagccucccaaguagcugggauuacaggugu

SEQ ID NO: 532917 - RNA, 32 nt, Human
uuagccucccaagucacugggauuacaggugc

SEQ ID NO: 532918 - RNA, 32 nt, Human
uuagccucccagaguacugggauuacaggcuc

SEQ ID NO: 532919 - RNA, 32 nt, Human
uuagccucccgaguaacugggauuauaggcau

SEQ ID NO: 532920 - RNA, 32 nt, Human
uuagccucccgaguagcugggauuacagccug

SEQ ID NO: 532921 - RNA, 32 nt, Human
uuagccucccgaguagcugggauuacaggcgc

SEQ ID NO: 532922 - RNA, 32 nt, Human
uuagccuccuaaagugcugggauuauaggcau

SEQ ID NO: 532923 - RNA, 32 nt, Human
uuagccuccuaaguagcugggauuacaagugc

SEQ ID NO: 532924 - RNA, 32 nt, Human
uuagccuccugaguagcugggauucucuacuu

SEQ ID NO: 532925 - RNA, 32 nt, Human
uuagccucucaaaaugcugggauuacaggugu

SEQ ID NO: 532926 - RNA, 32 nt, Human
uuagccucucaaguagcugggauuacaggcgc

SEQ ID NO: 532927 - RNA, 32 nt, Human
uuagccucuccccucuuggccuccuuucccac

SEQ ID NO: 532928 - RNA, 32 nt, Human
uuagccucugcuucaagcuuagcaauauauuc

SEQ ID NO: 532929 - RNA, 32 nt, Human
uuagccucuucucuaaaugcuuccucaagcuu

SEQ ID NO: 532930 - RNA, 32 nt, Human
uuagccuggaggucaaggcugcagugagccau

SEQ ID NO: 532931 - RNA, 32 nt, Human
uuagccuggccugagacaggacaggaaggggc

SEQ ID NO: 532932 - RNA, 32 nt, Human
uuagccugggcaccuggcucaaucuuguaacu

SEQ ID NO: 532933 - RNA, 32 nt, Human
uuagccugggcgacaagagcaagacuccaucu

SEQ ID NO: 532934 - RNA, 23 nt, Human
uuagccugggcgacagagcgaga

SEQ ID NO: 532935 - RNA, 19 nt, Human
uuagccugggcgaccgaga

SEQ ID NO: 532936 - RNA, 23 nt, Human
uuagccugggugacagagcgaga

SEQ ID NO: 532937 - RNA, 23 nt, Human
uuagccugggugacagagugaga

SEQ ID NO: 532938 - RNA, 32 nt, Human
uuagccugguaaggccgggugcaguggcucac

SEQ ID NO: 532939 - RNA, 32 nt, Human
uuagccugguggcaguggugagggagugagga

SEQ ID NO: 532940 - RNA, 32 nt, Human
uuagccuguccugucaucaucauggccagcug

SEQ ID NO: 532941 - RNA, 32 nt, Human
uuagccuguggucuccugugugcugcugcccg

SEQ ID NO: 532942 - RNA, 32 nt, Human
uuagccuuaucugucauuaucucccuuucucc

SEQ ID NO: 532943 - RNA, 32 nt, Human
uuagccuuauggacugccccuggaccaucacc

SEQ ID NO: 532944 - RNA, 32 nt, Human
uuagccuucauaugcccuucccugcaugcuuc

SEQ ID NO: 532945 - RNA, 32 nt, Human
uuagccuucccagggaaggaaccaugccccac

SEQ ID NO: 532946 - RNA, 32 nt, Human
uuagccuucccuaaccuccucaguguuuucua

SEQ ID NO: 532947 - RNA, 32 nt, Human
uuagccuugacaaaaugucucaguuaaguaua

SEQ ID NO: 532948 - RNA, 26 nt, Human
uuagccuuugucugagaauggguuua

SEQ ID NO: 532949 - RNA, 32 nt, Human
uuagccuuuuuaaaaaugugacuuuaacccgc

SEQ ID NO: 532950 - RNA, 32 nt, Human
uuagcgaagcacccaccucccuuuucucagcc

SEQ ID NO: 532951 - RNA, 32 nt, Human
uuagcgauuaaaaucucuagguggugagagua

SEQ ID NO: 532952 - RNA, 32 nt, Human
uuagcgccuggccggcuggaggcugcacagac

SEQ ID NO: 532953 - RNA, 32 nt, Human
uuagcggccggguggagguggggagggaagac

SEQ ID NO: 532954 - RNA, 32 nt, Human
uuagcggggagaaaggagggucgcccagcuuu

SEQ ID NO: 532955 - RNA, 32 nt, Human
uuagcggggagagagauggagcaucgagugac

SEQ ID NO: 532956 - RNA, 32 nt, Human
uuagcggggagggaagccaggggauuuugaag

SEQ ID NO: 532957 - RNA, 32 nt, Human
uuagcggguucagugggcucaaucugcgcagc

SEQ ID NO: 532958 - RNA, 31 nt, Human
uuagcgugacuucaguuuugacuaaggauga

SEQ ID NO: 532959 - RNA, 32 nt, Human
uuagcguggacagauacuccaucucuauuauc

SEQ ID NO: 532960 - RNA, 32 nt, Human
uuagcuaaaauggaucaauuccuugcaagaug

SEQ ID NO: 532961 - RNA, 32 nt, Human
uuagcuaaacuuccacuucauaacuuucggcg

SEQ ID NO: 532962 - RNA, 32 nt, Human
uuagcuaacauacccucccucuccacaacccc

SEQ ID NO: 532963 - RNA, 32 nt, Human
uuagcuacucgagaggccaaagaaggaggaug

SEQ ID NO: 532964 - RNA, 32 nt, Human
uuagcuagacagaaaaguuccccaagucccca

SEQ ID NO: 532965 - RNA, 32 nt, Human
uuagcuagagucagaccagaaugaaaaugcca

SEQ ID NO: 532966 - RNA, 32 nt, Human
uuagcuaggagacuggaaaaagaccaggaggc

SEQ ID NO: 532967 - RNA, 32 nt, Human
uuagcuaggcaugguggcacaugccuguaauc

SEQ ID NO: 532968 - RNA, 32 nt, Human
uuagcuagggcuuaaauaaacauguugcuaug

SEQ ID NO: 532969 - RNA, 32 nt, Human
uuagcuaguagcaaccguguuuucuccagauc

SEQ ID NO: 532970 - RNA, 32 nt, Human
uuagcuagucuucauguacugguacaaaagaa

SEQ ID NO: 532971 - RNA, 32 nt, Human
uuagcuauuguuauuaacaagaucuccauggc

SEQ ID NO: 532972 - RNA, 32 nt, Human
uuagcuauuuauuguucgaugccugcaugcug

SEQ ID NO: 532973 - RNA, 32 nt, Human
uuagcucacaugcacugagaauucuuuacagc

SEQ ID NO: 532974 - RNA, 32 nt, Human
uuagcucaccgcaaccuccaccucccggguuc

SEQ ID NO: 532975 - RNA, 32 nt, Human
uuagcucacuacaaccuccacuuuccagguuc

SEQ ID NO: 532976 - RNA, 32 nt, Human
uuagcucacugcaacccccgccucccggguuc

SEQ ID NO: 532977 - RNA, 32 nt, Human
uuagcucacugcaaccuccaccucccagguuc

SEQ ID NO: 532978 - RNA, 32 nt, Human
uuagcucacugcaaccuccaccucccggguuc

SEQ ID NO: 532979 - RNA, 32 nt, Human
uuagcucacugcaaccuccgccuccuggguuc

SEQ ID NO: 532980 - RNA, 32 nt, Human
uuagcucacugcaagcuccgccucccagguuc

SEQ ID NO: 532981 - RNA, 32 nt, Human
uuagcucacugcagccuccaccucccaggcuc

SEQ ID NO: 532982 - RNA, 32 nt, Human
uuagcucagaggagaggagcaaacaggaaaau

SEQ ID NO: 532983 - RNA, 32 nt, Human
uuagcucagcgcuugacauuuccuaagugugc

SEQ ID NO: 532984 - RNA, 32 nt, Human
uuagcucagguccaccaugggggacggcccag

SEQ ID NO: 532985 - RNA, 32 nt, Human
uuagcucauuuaaaucaaaauguguacuuuaa

SEQ ID NO: 532986 - RNA, 32 nt, Human
uuagcuccacugcccuuugagggauggaacug

SEQ ID NO: 532987 - RNA, 32 nt, Human
uuagcuccaguggaaccauagccacauaaaac

SEQ ID NO: 532988 - RNA, 32 nt, Human
uuagcuccaucuuuuccucacucccucugauu

SEQ ID NO: 532989 - RNA, 32 nt, Human
uuagcuccccauccucccuccucacucccucc

SEQ ID NO: 532990 - RNA, 32 nt, Human
uuagcucccuggggcccccugcugcugugccc

SEQ ID NO: 532991 - RNA, 32 nt, Human
uuagcuccuccacgaucccaucaugaccuaag

SEQ ID NO: 532992 - RNA, 32 nt, Human
uuagcuccuggcagagggugaguggggaccua

SEQ ID NO: 532993 - RNA, 32 nt, Human
uuagcuccuguggccccacccugggcccuggg

SEQ ID NO: 532994 - RNA, 26 nt, Human
uuagcuccugugguccuuggggcuua

SEQ ID NO: 532995 - RNA, 32 nt, Human
uuagcucuaguucucccccagcaucacuaaca

SEQ ID NO: 532996 - RNA, 32 nt, Human
uuagcucucugcaaccucugccucccagguuc

SEQ ID NO: 532997 - RNA, 32 nt, Human
uuagcucugccaugguuccuggcauuuaauca

SEQ ID NO: 532998 - RNA, 32 nt, Human
uuagcugaccaaaggggucagcagggauggcg

SEQ ID NO: 532999 - RNA, 32 nt, Human
uuagcugacuugcuagugagcuugcuuuaaaa

SEQ ID NO: 533000 - RNA, 24 nt, Human
uuagcugcaagaaugcacuuuaga

SEQ ID NO: 533001 - RNA, 23 nt, Human
uuagcugcaaucucuacuuucga

SEQ ID NO: 533002 - RNA, 32 nt, Human
uuagcugcacuggaauuucuuaccaaccaaau

SEQ ID NO: 533003 - RNA, 32 nt, Human
uuagcugcagaacccacaugugaauccuugua

SEQ ID NO: 533004 - RNA, 21 nt, Human
uuagcugcauaucaccuuagg

SEQ ID NO: 533005 - RNA, 32 nt, Human
uuagcugccagcucuguuauuucugccccuuc

SEQ ID NO: 533006 - RNA, 32 nt, Human
uuagcugcccucugcugacuucugcccuucac

SEQ ID NO: 533007 - RNA, 32 nt, Human
uuagcugcuacaccguguucaucaggaaaggu

SEQ ID NO: 533008 - RNA, 32 nt, Human
uuagcugcuacuuugagaccucggugauguua

SEQ ID NO: 533009 - RNA, 32 nt, Human
uuagcugcucacuggccccgcuugucuggccg

SEQ ID NO: 533010 - RNA, 32 nt, Human
uuagcugcucugcucugugcugggcuuguggg

SEQ ID NO: 533011 - RNA, 21 nt, Human
uuagcugcugaugacggcagg

SEQ ID NO: 533012 - RNA, 32 nt, Human
uuagcugcugcccugcccuugugaccugguca

SEQ ID NO: 533013 - RNA, 32 nt, Human
uuagcugcuguugccucccuucucaggcuggu

SEQ ID NO: 533014 - RNA, 32 nt, Human
uuagcugcuuccuccccuccuggcacccacug

SEQ ID NO: 533015 - RNA, 32 nt, Human
uuagcugcuucuauguuucauaguugggguca

SEQ ID NO: 533016 - RNA, 32 nt, Human
uuagcuggaaaccgcccaccucccucccgggu

SEQ ID NO: 533017 - RNA, 32 nt, Human
uuagcuggcuaggguugcuggaacagagggga

SEQ ID NO: 533018 - RNA, 32 nt, Human
uuagcugggagaaagagagagcuucuguugcu

SEQ ID NO: 533019 - RNA, 32 nt, Human
uuagcugggauuacaggcaugcgccaccaggc

SEQ ID NO: 533020 - RNA, 32 nt, Human
uuagcugggauuacaggcaugcgccaccauga

SEQ ID NO: 533021 - RNA, 32 nt, Human
uuagcugggauuacaggcaugugccacuaccc

SEQ ID NO: 533022 - RNA, 32 nt, Human
uuagcugggauuacaggcgugugccaccaugc

SEQ ID NO: 533023 - RNA, 32 nt, Human
uuagcugggcaugguggcaugcagugguaguc

SEQ ID NO: 533024 - RNA, 32 nt, Human
uuagcugggcaugguggcgugccugaaacccc

SEQ ID NO: 533025 - RNA, 32 nt, Human
uuagcugggcuucuccugcaauuccaccuaau

SEQ ID NO: 533026 - RNA, 32 nt, Human
uuagcuggggacauggaaguggacgaccaaac

SEQ ID NO: 533027 - RNA, 32 nt, Human
uuagcuggggucagaccugggguccucacugc

SEQ ID NO: 533028 - RNA, 32 nt, Human
uuagcugguaccucaguggggaggcuuccuua

SEQ ID NO: 533029 - RNA, 32 nt, Human
uuagcugucagugugacuuccuuucccaccca

SEQ ID NO: 533030 - RNA, 32 nt, Human
uuagcugucuuggcuacuaucugcaccuuuua

SEQ ID NO: 533031 - RNA, 32 nt, Human
uuagcuguuagacugaucuguuuguagcaguu

SEQ ID NO: 533032 - RNA, 32 nt, Human
uuagcuguugugaauagagcugcaauaaaugu

SEQ ID NO: 533033 - RNA, 32 nt, Human
uuagcuuagacuaagcuaccugccuucaaaau

SEQ ID NO: 533034 - RNA, 24 nt, Human
uuagcuuccagagggugagugagg

SEQ ID NO: 533035 - RNA, 32 nt, Human
uuagcuucccagccaaggugcugguguugcca

SEQ ID NO: 533036 - RNA, 32 nt, Human
uuagcuucccuaauuaccuuucacugacauac

SEQ ID NO: 533037 - RNA, 32 nt, Human
uuagcuuccuccugggucauuuacagacuccc

SEQ ID NO: 533038 - RNA, 32 nt, Human
uuagcuuccuuuccuucuuccaucccuucuuc

SEQ ID NO: 533039 - RNA, 32 nt, Human
uuagcuucucucuugaaucagaguaucauugu

SEQ ID NO: 533040 - RNA, 32 nt, Human
uuagcuucucuugccaccucaggggcuuggau

SEQ ID NO: 533041 - RNA, 32 nt, Human
uuagcuugaauuacaggguaaaagccaucacu

SEQ ID NO: 533042 - RNA, 32 nt, Human
uuagcuugcaggaaacacaaaauaaguaugca

SEQ ID NO: 533043 - RNA, 32 nt, Human
uuagcuuuaacacucaguuuucuaaagggaca

SEQ ID NO: 533044 - RNA, 32 nt, Human
uuagcuuuacaaaggucccacuggucccaucu

SEQ ID NO: 533045 - RNA, 32 nt, Human
uuagcuuugagucuuuaauaaacuaccuuuca

SEQ ID NO: 533046 - RNA, 22 nt, Human
uuagcuuuugaaaguguuuuaa

SEQ ID NO: 533047 - RNA, 32 nt, Human
uuaggaaacauacccaggaaguacaguugaua

SEQ ID NO: 533048 - RNA, 32 nt, Human
uuaggaaacuaagucuguggcucuucucugcu

SEQ ID NO: 533049 - RNA, 32 nt, Human
uuaggaaagacaugucugaaaugaguauagau

SEQ ID NO: 533050 - RNA, 32 nt, Human
uuaggaaaucuaggacuuccagcuucccucau

SEQ ID NO: 533051 - RNA, 32 nt, Human
uuaggaaaugcccgugaacuugcccucugggc

SEQ ID NO: 533052 - RNA, 32 nt, Human
uuaggaaccggggcagagucagcucugugcug

SEQ ID NO: 533053 - RNA, 32 nt, Human
uuaggaagaacuggugcccccuccaguccuaa

SEQ ID NO: 533054 - RNA, 32 nt, Human
uuaggaagaaggaggaaggaagaagguaaagg

SEQ ID NO: 533055 - RNA, 32 nt, Human
uuaggaagagccuuccacccaggggcagcccc

SEQ ID NO: 533056 - RNA, 32 nt, Human
uuaggaaggaaggcaacugugaggcuucugag

SEQ ID NO: 533057 - RNA, 32 nt, Human
uuaggaaggcaccaaagaaccuccucugcacu

SEQ ID NO: 533058 - RNA, 32 nt, Human
uuaggaaggccugaaaccaccuuguuaccuuu

SEQ ID NO: 533059 - RNA, 32 nt, Human
uuaggaagguggcggccagggaugaggaggcc

SEQ ID NO: 533060 - RNA, 32 nt, Human
uuaggaaguggugucagcagagacugagcugc

SEQ ID NO: 533061 - RNA, 32 nt, Human
uuaggaaguguggagucagaaugcaaacccag

SEQ ID NO: 533062 - RNA, 32 nt, Human
uuaggaauccugcuguuaaguuucucaugguu

SEQ ID NO: 533063 - RNA, 32 nt, Human
uuaggaaugaggagugggcaucaggccuggga

SEQ ID NO: 533064 - RNA, 32 nt, Human
uuaggaaugcacccggggccuccugcagauuu

SEQ ID NO: 533065 - RNA, 32 nt, Human
uuaggacaucaucuuggccaugaucuucuggg

SEQ ID NO: 533066 - RNA, 32 nt, Human
uuaggaccaauacaaaauaacaaaaauguaau

SEQ ID NO: 533067 - RNA, 32 nt, Human
uuaggaccagggauugucuugcaccaaguaug

SEQ ID NO: 533068 - RNA, 32 nt, Human
uuaggacgggaggcuguguccgugggugugca

SEQ ID NO: 533069 - RNA, 32 nt, Human
uuaggagaagaaaaguaagugaaggaauccuc

SEQ ID NO: 533070 - RNA, 32 nt, Human
uuaggagaagcccuuuaaaaagcugccuuccu

SEQ ID NO: 533071 - RNA, 32 nt, Human
uuaggagaagcgagagaaauggcaguggccac

SEQ ID NO: 533072 - RNA, 32 nt, Human
uuaggagacaaugaggaaggaggauggauucu

SEQ ID NO: 533073 - RNA, 32 nt, Human
uuaggagaccguugaaccuggaggggcccuag

SEQ ID NO: 533074 - RNA, 22 nt, Human
uuaggagacgcugcacuugaca

SEQ ID NO: 533075 - RNA, 32 nt, Human
uuaggagagcugaggccagcugcccacugagu

SEQ ID NO: 533076 - RNA, 32 nt, Human
uuaggagaggauccuugcucccaacgucuacu

SEQ ID NO: 533077 - RNA, 32 nt, Human
uuaggagagugggaagaaaggagcagagagag

SEQ ID NO: 533078 - RNA, 31 nt, Human
uuaggagaugagagagugaagggcugaccca

SEQ ID NO: 533079 - RNA, 32 nt, Human
uuaggagccuagggugucuccucugcuucugg

SEQ ID NO: 533080 - RNA, 32 nt, Human
uuaggagcucaguugagaaacaguuccauuca

SEQ ID NO: 533081 - RNA, 32 nt, Human
uuaggagcuccagguugggagcagugacagag

SEQ ID NO: 533082 - RNA, 32 nt, Human
uuaggagcuuagcucaaaguucagcuaaccuu

SEQ ID NO: 533083 - RNA, 32 nt, Human
uuaggagcuucaaacacauauaauuucucaag

SEQ ID NO: 533084 - RNA, 32 nt, Human
uuaggaggagcacgcgucccgcucgggcgcac

SEQ ID NO: 533085 - RNA, 32 nt, Human
uuaggaggagugagacaggugauaauggaucc

SEQ ID NO: 533086 - RNA, 32 nt, Human
uuaggaggaugucggggugaagggugguaucu

SEQ ID NO: 533087 - RNA, 32 nt, Human
uuaggaggccaaagcaggaggaucgcuugagc

SEQ ID NO: 533088 - RNA, 32 nt, Human
uuaggaggccaaggcagguggaucaugagauc

SEQ ID NO: 533089 - RNA, 32 nt, Human
uuaggaggccaaggcagguggaucgcuugagg

SEQ ID NO: 533090 - RNA, 32 nt, Human
uuaggaggccgaggcaggcggaucacuuaaga

SEQ ID NO: 533091 - RNA, 32 nt, Human
uuaggaggccgaggcggguggaucaugagguc

SEQ ID NO: 533092 - RNA, 32 nt, Human
uuaggaggccgagguggguggaucaugagguc

SEQ ID NO: 533093 - RNA, 32 nt, Human
uuaggaggccugauucacagacgcuacaggau

SEQ ID NO: 533094 - RNA, 32 nt, Human
uuaggaggcuagagagucaaggagaaccucaa

SEQ ID NO: 533095 - RNA, 32 nt, Human
uuaggaggcugaagcaggaggauugauugagc

SEQ ID NO: 533096 - RNA, 32 nt, Human
uuaggaggcugaggcaggagaaucacaucaac

SEQ ID NO: 533097 - RNA, 32 nt, Human
uuaggaggcugaggcaggagaaucgcuugaau

SEQ ID NO: 533098 - RNA, 32 nt, Human
uuaggaggcugaggcaggagaaucucuugaaa

SEQ ID NO: 533099 - RNA, 32 nt, Human
uuaggaggcugaggcaggaggaucauuugagc

SEQ ID NO: 533100 - RNA, 32 nt, Human
uuaggaggcugaggcaugagaaucacuuaaac

SEQ ID NO: 533101 - RNA, 32 nt, Human
uuaggaggcugaggcugguggaucacuugaag

SEQ ID NO: 533102 - RNA, 32 nt, Human
uuaggaggcugagguaggagaauugcuugaac

SEQ ID NO: 533103 - RNA, 32 nt, Human
uuaggaggcugagguaggagaauugcuugacc

SEQ ID NO: 533104 - RNA, 32 nt, Human
uuaggaggcugaggugggagaaucacuuggac

SEQ ID NO: 533105 - RNA, 32 nt, Human
uuaggaggcugagguuggagaaucgcuugagg

SEQ ID NO: 533106 - RNA, 32 nt, Human
uuaggaggcugaugcaggagaauuguuugaac

SEQ ID NO: 533107 - RNA, 32 nt, Human
uuaggagggaaugagccucagggaggagugag

SEQ ID NO: 533108 - RNA, 32 nt, Human
uuaggagguuuguuucagaccucugugggccg

SEQ ID NO: 533109 - RNA, 32 nt, Human
uuaggagucacugcuugugugguuccugggac

SEQ ID NO: 533110 - RNA, 32 nt, Human
uuaggagugagcuuggugagggcuccaaucug

SEQ ID NO: 533111 - RNA, 32 nt, Human
uuaggagugcuuccucacaguuaccaagaaua

SEQ ID NO: 533112 - RNA, 32 nt, Human
uuaggaguuugagaccagccugggcaacaugg

SEQ ID NO: 533113 - RNA, 32 nt, Human
uuaggaguuugagacuagccugggcaacccag

SEQ ID NO: 533114 - RNA, 32 nt, Human
uuaggauacagcucccuccuccaggcagccuu

SEQ ID NO: 533115 - RNA, 32 nt, Human
uuaggauacuuaacaaauacauucaaauucuu

SEQ ID NO: 533116 - RNA, 32 nt, Human
uuaggauaggagaaaggguucaugcacacacg

SEQ ID NO: 533117 - RNA, 32 nt, Human
uuaggauauuuucauacacauaggguaucuug

SEQ ID NO: 533118 - RNA, 32 nt, Human
uuaggauccaaagcuucucugcuccuuuuguu

SEQ ID NO: 533119 - RNA, 32 nt, Human
uuaggaucuccauggugggaaggaaggcaggc

SEQ ID NO: 533120 - RNA, 32 nt, Human
uuaggaugagccaccagaauaugccugcucaa

SEQ ID NO: 533121 - RNA, 32 nt, Human
uuaggaugcaggcuggguaugguggcucaugc

SEQ ID NO: 533122 - RNA, 32 nt, Human
uuaggaugccugcucugugcucucccugccuc

SEQ ID NO: 533123 - RNA, 32 nt, Human
uuaggauggaagggaacucugcacaaaaccuu

SEQ ID NO: 533124 - RNA, 32 nt, Human
uuaggauuucaacauaugaauuuuggaaggac

SEQ ID NO: 533125 - RNA, 32 nt, Human
uuaggauuugaacaauggagagaugaucauga

SEQ ID NO: 533126 - RNA, 32 nt, Human
uuaggauuuguucugcucagagcaccaccagg

SEQ ID NO: 533127 - RNA, 32 nt, Human
uuaggcaacacggugaaaccccaucucuacaa

SEQ ID NO: 533128 - RNA, 32 nt, Human
uuaggcaagggcccaaggacagugccuuaguu

SEQ ID NO: 533129 - RNA, 32 nt, Human
uuaggcacaagaaagcuaccauuuuuaacagu

SEQ ID NO: 533130 - RNA, 32 nt, Human
uuaggcacugcuaaucaagcaugaagaggaac

SEQ ID NO: 533131 - RNA, 32 nt, Human
uuaggcacuguguggaaaguguuaagggguag

SEQ ID NO: 533132 - RNA, 23 nt, Human
uuaggcacuguucuaaauauuaa

SEQ ID NO: 533133 - RNA, 32 nt, Human
uuaggcagccuggagaaaaccagagauccagu

SEQ ID NO: 533134 - RNA, 32 nt, Human
uuaggcagggccucuggcuggggccaggguua

SEQ ID NO: 533135 - RNA, 20 nt, Human
uuaggcaguaucauuuccau

SEQ ID NO: 533136 - RNA, 32 nt, Human
uuaggcauagggcugaacaguccuuccagagc

SEQ ID NO: 533137 - RNA, 23 nt, Human
uuaggcauauguaguaauauuag

SEQ ID NO: 533138 - RNA, 32 nt, Human
uuaggcauggguggaaagugcucagugaagua

SEQ ID NO: 533139 - RNA, 23 nt, Human
uuaggcauuaguuuggcaauaug

SEQ ID NO: 533140 - RNA, 23 nt, Human
uuaggcauuggcaucauuauuag

SEQ ID NO: 533141 - RNA, 32 nt, Human
uuaggccaccuucucccuuuccuggaccccag

SEQ ID NO: 533142 - RNA, 32 nt, Human
uuaggccacuggcuuagaguacuccuuccccu

SEQ ID NO: 533143 - RNA, 32 nt, Human
uuaggccaggagaugaaggaguucaguagcaa

SEQ ID NO: 533144 - RNA, 32 nt, Human
uuaggccagggugggagcagugaacggaguca

SEQ ID NO: 533145 - RNA, 32 nt, Human
uuaggccauugcacuccagccucagcaacaag

SEQ ID NO: 533146 - RNA, 32 nt, Human
uuaggcccagaguuggagaccaaccugggcaa

SEQ ID NO: 533147 - RNA, 32 nt, Human
uuaggcccagcaccaaauauucaccaucccuu

SEQ ID NO: 533148 - RNA, 32 nt, Human
uuaggcccagcaccaaauauucaccauccguu

SEQ ID NO: 533149 - RNA, 32 nt, Human
uuaggcccaguucaugcuaaaagauggacucu

SEQ ID NO: 533150 - RNA, 32 nt, Human
uuaggcccccaucauccucuggcuuggccaca

SEQ ID NO: 533151 - RNA, 32 nt, Human
uuaggccccucaggacccagggaaugccaggg

SEQ ID NO: 533152 - RNA, 32 nt, Human
uuaggcccugcacuccaccuggggacggcccc

SEQ ID NO: 533153 - RNA, 32 nt, Human
uuaggccucccaacuucuccccaggccaagua

SEQ ID NO: 533154 - RNA, 32 nt, Human
uuaggccugcaccugcccauccagaaagcagc

SEQ ID NO: 533155 - RNA, 32 nt, Human
uuaggccugccuccccaggacuccuuagaucc

SEQ ID NO: 533156 - RNA, 32 nt, Human
uuaggccuggaagguugaggcugcuauaagcu

SEQ ID NO: 533157 - RNA, 32 nt, Human
uuaggccuggggagccauagggcuggcuucuc

SEQ ID NO: 533158 - RNA, 32 nt, Human
uuaggccuuggcuugauggaagugggccaguc

SEQ ID NO: 533159 - RNA, 32 nt, Human
uuaggccuuugaucuuccucucuaguguauaa

SEQ ID NO: 533160 - RNA, 32 nt, Human
uuaggccuuuugacuccagcugagggggacag

SEQ ID NO: 533161 - RNA, 32 nt, Human
uuaggcgacuccugguguucgccccggacaag

SEQ ID NO: 533162 - RNA, 32 nt, Human
uuaggcggagagcgccgggcagagggggaggg

SEQ ID NO: 533163 - RNA, 32 nt, Human
uuaggcggauugggucucucugcuguggcguu

SEQ ID NO: 533164 - RNA, 32 nt, Human
uuaggcgggagaaucacuugaacccaggaggu

SEQ ID NO: 533165 - RNA, 32 nt, Human
uuaggcgggaggaucacuugaguccaggaguu

SEQ ID NO: 533166 - RNA, 32 nt, Human
uuaggcgugguugagaaaaagcagaaacuuua

SEQ ID NO: 533167 - RNA, 32 nt, Human
uuaggcguuccagaccagccugggcaacauag

SEQ ID NO: 533168 - RNA, 32 nt, Human
uuaggcuaggaauucaagaccagccuggccaa

SEQ ID NO: 533169 - RNA, 32 nt, Human
uuaggcucauaguuuguggaaaaaucccaaua

SEQ ID NO: 533170 - RNA, 32 nt, Human
uuaggcucuccaaggacacuuguggacaucac

SEQ ID NO: 533171 - RNA, 32 nt, Human
uuaggcugaacugucucuuauagaaugagguc

SEQ ID NO: 533172 - RNA, 32 nt, Human
uuaggcugcagcuugccacuccugggcugggu

SEQ ID NO: 533173 - RNA, 32 nt, Human
uuaggcugccauuccagagaaggaggaaaugc

SEQ ID NO: 533174 - RNA, 32 nt, Human
uuaggcuggagugcaguggcacgaucauagcu

SEQ ID NO: 533175 - RNA, 32 nt, Human
uuaggcuggcaggccggcugaggggcgcgggc

SEQ ID NO: 533176 - RNA, 31 nt, Human
uuaggcuuauagucucccauaguugagauug

SEQ ID NO: 533177 - RNA, 32 nt, Human
uuaggcuucaaacuuguacgacaugucacugu

SEQ ID NO: 533178 - RNA, 32 nt, Human
uuaggcuugaugacccagaaucuaggauucuc

SEQ ID NO: 533179 - RNA, 32 nt, Human
uuaggcuugcugucuccuaaggucacccaagc

SEQ ID NO: 533180 - RNA, 32 nt, Human
uuaggcuuggcgcgguggcucacgcauguaau

SEQ ID NO: 533181 - RNA, 31 nt, Human
uuagggaacaggguugacacagcagggcuag

SEQ ID NO: 533182 - RNA, 32 nt, Human
uuagggaacaucagcaagacccaucccaggag

SEQ ID NO: 533183 - RNA, 32 nt, Human
uuagggaagggagccauugagcacagacuuug

SEQ ID NO: 533184 - RNA, 32 nt, Human
uuagggaagugaguagcugaucaacaccuuaa

SEQ ID NO: 533185 - RNA, 32 nt, Human
uuagggacacagauuguggcgccgugauggaa

SEQ ID NO: 533186 - RNA, 32 nt, Human
uuagggacaggcucguguuguccaguuugccc

SEQ ID NO: 533187 - RNA, 32 nt, Human
uuagggacugauuuuuaauucugacacccaca

SEQ ID NO: 533188 - RNA, 32 nt, Human
uuagggacuguaguggauuauggccaagcagc

SEQ ID NO: 533189 - RNA, 32 nt, Human
uuagggagauuugcauucaggccagggauuug

SEQ ID NO: 533190 - RNA, 32 nt, Human
uuagggagcagugccuuucagaauuucagaau

SEQ ID NO: 533191 - RNA, 32 nt, Human
uuagggagcccaaauggcuacagaucugguaa

SEQ ID NO: 533192 - RNA, 32 nt, Human
uuagggagcgggagcaaggggccuuccgagga

SEQ ID NO: 533193 - RNA, 32 nt, Human
uuagggaggaagaaaugaugucugagcugaau

SEQ ID NO: 533194 - RNA, 32 nt, Human
uuagggaggaagaggcaggcgaugagucuagu

SEQ ID NO: 533195 - RNA, 32 nt, Human
uuagggaggcuaagcagucucuguuuugcuuc

SEQ ID NO: 533196 - RNA, 32 nt, Human
uuagggagggcuguggagccgggaaccaagac

SEQ ID NO: 533197 - RNA, 32 nt, Human
uuagggaggguugaugggggaggcguggggaa

SEQ ID NO: 533198 - RNA, 23 nt, Human
uuagggaucacacaacuuacuua

SEQ ID NO: 533199 - RNA, 32 nt, Human
uuagggcagagggagcugggcagggcacagca

SEQ ID NO: 533200 - RNA, 32 nt, Human
uuagggcagggaggggacuggggaagugcgca

SEQ ID NO: 533201 - RNA, 32 nt, Human
uuagggcccugccucuguuucaugaugcaugg

SEQ ID NO: 533202 - RNA, 32 nt, Human
uuagggccgagugggagcgcagagccccuccc

SEQ ID NO: 533203 - RNA, 32 nt, Human
uuagggccgggacaucccgaggagccgcggug

SEQ ID NO: 533204 - RNA, 32 nt, Human
uuagggccuacccuggagugcugcagugugug

SEQ ID NO: 533205 - RNA, 32 nt, Human
uuagggccuuuccaagauugcuguuuuuguuu

SEQ ID NO: 533206 - RNA, 32 nt, Human
uuagggcgugagccaccgcgcccagcuucugg

SEQ ID NO: 533207 - RNA, 32 nt, Human
uuagggcucaauuuccugauuguaguagaggu

SEQ ID NO: 533208 - RNA, 32 nt, Human
uuagggcuggaaggcagcaucccucugacagg

SEQ ID NO: 533209 - RNA, 32 nt, Human
uuagggcuucagccugugaauaugagacucac

SEQ ID NO: 533210 - RNA, 32 nt, Human
uuaggggaaggagagagggaagggucagggua

SEQ ID NO: 533211 - RNA, 32 nt, Human
uuaggggacagggugagcagguuuggaggcaa

SEQ ID NO: 533212 - RNA, 32 nt, Human
uuaggggacuccugagguccuaucuccaggcu

SEQ ID NO: 533213 - RNA, 31 nt, Human
uuaggggagaaacugccucagugccauuuaa

SEQ ID NO: 533214 - RNA, 32 nt, Human
uuaggggaggagaaggagagguuauaccuuca

SEQ ID NO: 533215 - RNA, 32 nt, Human
uuaggggaggcaggcaggugggugagcagcag

SEQ ID NO: 533216 - RNA, 32 nt, Human
uuaggggagggcagaggccugcaguuuggcuu

SEQ ID NO: 533217 - RNA, 32 nt, Human
uuaggggauguggggaccaggagaaagucagg

SEQ ID NO: 533218 - RNA, 32 nt, Human
uuaggggccagccugccuccaccucccacccc

SEQ ID NO: 533219 - RNA, 32 nt, Human
uuagggggagggaagcugaaaucauugaugua

SEQ ID NO: 533220 - RNA, 32 nt, Human
uuagggggauuauaaaacuaaucaucaaagcc

SEQ ID NO: 533221 - RNA, 31 nt, Human
uuagggguaauaaauacuuggcuuggaaauu

SEQ ID NO: 533222 - RNA, 32 nt, Human
uuaggguacaagaagccuguucuguccagcuu

SEQ ID NO: 533223 - RNA, 32 nt, Human
uuaggguaccggaagcagaaccccugggcuga

SEQ ID NO: 533224 - RNA, 32 nt, Human
uuaggguagugguucucaucuaccuuggagug

SEQ ID NO: 533225 - RNA, 32 nt, Human
uuagggucauucuccuuaauaggcuuuuaugu

SEQ ID NO: 533226 - RNA, 32 nt, Human
uuaggguccugcugucugucauguugccuugu

SEQ ID NO: 533227 - RNA, 32 nt, Human
uuagggucucuggcccuguucuugccccagca

SEQ ID NO: 533228 - RNA, 32 nt, Human
uuagggugagaucugcuguaccagucucacag

SEQ ID NO: 533229 - RNA, 32 nt, Human
uuaggguggugccaccacugcagacuauugug

SEQ ID NO: 533230 - RNA, 32 nt, Human
uuagggugucauugucauuugagagacugaca

SEQ ID NO: 533231 - RNA, 32 nt, Human
uuaggguguguauccaacccagugcuuccuaa

SEQ ID NO: 533232 - RNA, 32 nt, Human
uuaggguuauguuuuuaggauuccccucaaug

SEQ ID NO: 533233 - RNA, 32 nt, Human
uuaggguucacaguuggacaaaaugaguuuga

SEQ ID NO: 533234 - RNA, 32 nt, Human
uuaggguuugcagaguggaaacucagccguag

SEQ ID NO: 533235 - RNA, 32 nt, Human
uuaggguuugcgacuccgccucccugggaccu

SEQ ID NO: 533236 - RNA, 32 nt, Human
uuaggguuuuucaggcugggcacagugacuca

SEQ ID NO: 533237 - RNA, 32 nt, Human
uuagguaacguauuggaccugcccacaacucc

SEQ ID NO: 533238 - RNA, 32 nt, Human
uuagguaacuauugugucuuccuucacuaucu

SEQ ID NO: 533239 - RNA, 32 nt, Human
uuagguacaaugcaugcaucacagacuguauu

SEQ ID NO: 533240 - RNA, 32 nt, Human
uuagguagcaagacauauugaaugcaaaguuc

SEQ ID NO: 533241 - RNA, 32 nt, Human
uuagguagccccggaaaggucgggaggaggag

SEQ ID NO: 533242 - RNA, 32 nt, Human
uuaggucagaaguucaagaucagccugggcaa

SEQ ID NO: 533243 - RNA, 32 nt, Human
uuaggucagcacuugauucguuguugcuguga

SEQ ID NO: 533244 - RNA, 32 nt, Human
uuaggucaggaguucaacgccagccuggccaa

SEQ ID NO: 533245 - RNA, 32 nt, Human
uuaggucagugacugaagggaccaagaacgca

SEQ ID NO: 533246 - RNA, 32 nt, Human
uuaggucauuuauuaauuuucuuacaggugca

SEQ ID NO: 533247 - RNA, 32 nt, Human
uuagguccugcugccccugcugccucagcccu

SEQ ID NO: 533248 - RNA, 32 nt, Human
uuaggucucauggaccaguggcuggucucacc

SEQ ID NO: 533249 - RNA, 32 nt, Human
uuaggucugguguggcuuauucuucuagcugc

SEQ ID NO: 533250 - RNA, 32 nt, Human
uuaggucugugauccaggcuucagcagacaau

SEQ ID NO: 533251 - RNA, 32 nt, Human
uuaggugaaagaacuagcagaaagucaaaaac

SEQ ID NO: 533252 - RNA, 32 nt, Human
uuaggugacauggugacaucuaucccuuuauu

SEQ ID NO: 533253 - RNA, 32 nt, Human
uuaggugaucgagggugugcccagggggcgga

SEQ ID NO: 533254 - RNA, 32 nt, Human
uuaggugcuugggaacacaaugcucccaguuc

SEQ ID NO: 533255 - RNA, 32 nt, Human
uuagguggaaucgcugugcaugugcaggaaug

SEQ ID NO: 533256 - RNA, 31 nt, Human
uuagguggacuuuucugagaucuuguagaaa

SEQ ID NO: 533257 - RNA, 32 nt, Human
uuagguggaguuucacucuguugcccaggcug

SEQ ID NO: 533258 - RNA, 32 nt, Human
uuagguggcgucucacccuauugcccaggcug

SEQ ID NO: 533259 - RNA, 32 nt, Human
uuagguggcugagacagguggaucaugagguc

SEQ ID NO: 533260 - RNA, 32 nt, Human
uuaggugggaaacagcuggagacucugggaug

SEQ ID NO: 533261 - RNA, 32 nt, Human
uuaggugggcggggcuccugagggagcuccaa

SEQ ID NO: 533262 - RNA, 32 nt, Human
uuaggugggggaggggcgacaguagugagcgc

SEQ ID NO: 533263 - RNA, 32 nt, Human
uuagguguaacgagaagagauccucagcagaa

SEQ ID NO: 533264 - RNA, 32 nt, Human
uuagguguaguggcaggcaccuguaaucccag

SEQ ID NO: 533265 - RNA, 32 nt, Human
uuaggugugcagaagcuuuccuuucccuaccc

SEQ ID NO: 533266 - RNA, 32 nt, Human
uuaggugugguggcucacaccuguaaucccag

SEQ ID NO: 533267 - RNA, 32 nt, Human
uuagguguugagauggggcagcucugaauccu

SEQ ID NO: 533268 - RNA, 32 nt, Human
uuagguuaaaucugaauuuccacugcuuugga

SEQ ID NO: 533269 - RNA, 32 nt, Human
uuagguuaauuuucuaguaaaacacguugccu

SEQ ID NO: 533270 - RNA, 32 nt, Human
uuagguuccaggaacuuccugagaacacccga

SEQ ID NO: 533271 - RNA, 32 nt, Human
uuagguucccagaggacugagggaauccugua

SEQ ID NO: 533272 - RNA, 32 nt, Human
uuagguuccccuggacuccagccaaggcuguu

SEQ ID NO: 533273 - RNA, 32 nt, Human
uuagguuccuuaucucuccugagccuugggcu

SEQ ID NO: 533274 - RNA, 32 nt, Human
uuagguucuugaguaguucugcucuuaaacgu

SEQ ID NO: 533275 - RNA, 32 nt, Human
uuagguuucugcuggucucugcccccugugac

SEQ ID NO: 533276 - RNA, 32 nt, Human
uuagguuuuuccccaucuccuguagagcgaau

SEQ ID NO: 533277 - RNA, 32 nt, Human
uuaguaaaaggaguaacaaacaagauugugau

SEQ ID NO: 533278 - RNA, 32 nt, Human
uuaguaaagacaggguuucaccauguuggcca

SEQ ID NO: 533279 - RNA, 32 nt, Human
uuaguaaagacaggguuucaccguguuagcca

SEQ ID NO: 533280 - RNA, 32 nt, Human
uuaguaaagacaggguuucaucauguuggccu

SEQ ID NO: 533281 - RNA, 32 nt, Human
uuaguaaagacaggguuucuccauguugguca

SEQ ID NO: 533282 - RNA, 32 nt, Human
uuaguaaauaaauacauuacauuuuuguauuu

SEQ ID NO: 533283 - RNA, 23 nt, Human
uuaguaaauuagaacuccuaccu

SEQ ID NO: 533284 - RNA, 32 nt, Human
uuaguaaccuuaaauuuuagugaaaaccuagg

SEQ ID NO: 533285 - RNA, 32 nt, Human
uuaguaagacuagacaguaacagaagccaguu

SEQ ID NO: 533286 - RNA, 32 nt, Human
uuaguaaggcauuugggguuggggaagcuaga

SEQ ID NO: 533287 - RNA, 32 nt, Human
uuaguaaguugcugauuuauggugcuaaagaa

SEQ ID NO: 533288 - RNA, 32 nt, Human
uuaguaauaagaauacagggaaaugucuucag

SEQ ID NO: 533289 - RNA, 31 nt, Human
uuaguaaucgucucugacaugccaaacaccc

SEQ ID NO: 533290 - RNA, 32 nt, Human
uuaguaaugacaggguuucaccguguuggcca

SEQ ID NO: 533291 - RNA, 32 nt, Human
uuaguaauggcagagcagucuaaacagagucc

SEQ ID NO: 533292 - RNA, 32 nt, Human
uuaguaauucaggucuggaauggggcuuagga

SEQ ID NO: 533293 - RNA, 32 nt, Human
uuaguaauuuaaaucagaaauauuuuauaaaa

SEQ ID NO: 533294 - RNA, 32 nt, Human
uuaguacagacaggguuucacuguguuagcca

SEQ ID NO: 533295 - RNA, 32 nt, Human
uuaguacagacaggguuugacuauguuggcca

SEQ ID NO: 533296 - RNA, 32 nt, Human
uuaguacagccacauaaugugccaucuauugu

SEQ ID NO: 533297 - RNA, 32 nt, Human
uuaguacaugggagggcuagccccgggacuug

SEQ ID NO: 533298 - RNA, 32 nt, Human
uuaguaccaguagaauggggugcugcugaaaa

SEQ ID NO: 533299 - RNA, 32 nt, Human
uuaguacccugcaggccaggccagcuuccccu

SEQ ID NO: 533300 - RNA, 32 nt, Human
uuaguaccuuacuguagacagaguguggguga

SEQ ID NO: 533301 - RNA, 31 nt, Human
uuaguacucaauaaacaaugcauugaaugag

SEQ ID NO: 533302 - RNA, 32 nt, Human
uuaguacucucaucucugguuccauuccaguu

SEQ ID NO: 533303 - RNA, 32 nt, Human
uuaguacugaggaauuuucaugugccacauac

SEQ ID NO: 533304 - RNA, 32 nt, Human
uuaguacuggaauagagguggccaggccccca

SEQ ID NO: 533305 - RNA, 32 nt, Human
uuaguacuuguaaauaaacacacacauuaagg

SEQ ID NO: 533306 - RNA, 32 nt, Human
uuaguagaaacgagguuucaacauguuggcca

SEQ ID NO: 533307 - RNA, 32 nt, Human
uuaguagaaacgagguuucaccacguuggcca

SEQ ID NO: 533308 - RNA, 32 nt, Human
uuaguagacgucuucauucauuggaguaacug

SEQ ID NO: 533309 - RNA, 32 nt, Human
uuaguagagacagaguuucaccauguuggcca

SEQ ID NO: 533310 - RNA, 32 nt, Human
uuaguagagacagaguuucgccauguuggcca

SEQ ID NO: 533311 - RNA, 32 nt, Human
uuaguagagacagaguuuuaccauguuggcca

SEQ ID NO: 533312 - RNA, 32 nt, Human
uuaguagagacagaguuuugccauguuggcca

SEQ ID NO: 533313 - RNA, 32 nt, Human
uuaguagagacagaguuuugcuauguuggcca

SEQ ID NO: 533314 - RNA, 32 nt, Human
uuaguagagacagaguuuugcuguguugguca

SEQ ID NO: 533315 - RNA, 32 nt, Human
uuaguagagacagcguuucaccauguuagcca

SEQ ID NO: 533316 - RNA, 32 nt, Human
uuaguagagacagcguuucaccauguuagcua

SEQ ID NO: 533317 - RNA, 32 nt, Human
uuaguagagacaggaucucccuauguugucca

SEQ ID NO: 533318 - RNA, 32 nt, Human
uuaguagagacaggauuucaccauguuggcca

SEQ ID NO: 533319 - RNA, 32 nt, Human
uuaguagagacaggauuucacuauguuggcca

SEQ ID NO: 533320 - RNA, 32 nt, Human
uuaguagagacaggauuucaucauguuggcca

SEQ ID NO: 533321 - RNA, 32 nt, Human
uuaguagagacaggauuucuccauguugguca

SEQ ID NO: 533322 - RNA, 32 nt, Human
uuaguagagacaggauuuuaccauguuggcca

SEQ ID NO: 533323 - RNA, 32 nt, Human
uuaguagagacaggauuuugccauguuugcca

SEQ ID NO: 533324 - RNA, 32 nt, Human
uuaguagagacaggcuuucgcuguguuggcca

SEQ ID NO: 533325 - RNA, 32 nt, Human
uuaguagagacagggcuucaccauguuggcaa

SEQ ID NO: 533326 - RNA, 32 nt, Human
uuaguagagacagggcuucaccauguuggcua

SEQ ID NO: 533327 - RNA, 32 nt, Human
uuaguagagacagggguuucuuccauguugcc

SEQ ID NO: 533328 - RNA, 32 nt, Human
uuaguagagacagggucucaccauguuggcca

SEQ ID NO: 533329 - RNA, 32 nt, Human
uuaguagagacaggguucuuaccauguuggcc

SEQ ID NO: 533330 - RNA, 32 nt, Human
uuaguagagacaggguuucaccaugucaagcu

SEQ ID NO: 533331 - RNA, 32 nt, Human
uuaguagagacaggguuucaccaugucagcca

SEQ ID NO: 533332 - RNA, 32 nt, Human
uuaguagagacaggguuucaccaugugagcca

SEQ ID NO: 533333 - RNA, 32 nt, Human
uuaguagagacaggguuucaccauguuagcca

SEQ ID NO: 533334 - RNA, 32 nt, Human
uuaguagagacaggguuucaccauguuagccg

SEQ ID NO: 533335 - RNA, 32 nt, Human
uuaguagagacaggguuucaccauguuaguca

SEQ ID NO: 533336 - RNA, 32 nt, Human
uuaguagagacaggguuucaccauguugccca

SEQ ID NO: 533337 - RNA, 32 nt, Human
uuaguagagacaggguuucaccauguugccua

SEQ ID NO: 533338 - RNA, 32 nt, Human
uuaguagagacaggguuucaccauguuggaca

SEQ ID NO: 533339 - RNA, 32 nt, Human
uuaguagagacaggguuucaccauguuggcca

SEQ ID NO: 533340 - RNA, 32 nt, Human
uuaguagagacaggguuucaccauguuggccg

SEQ ID NO: 533341 - RNA, 32 nt, Human
uuaguagagacaggguuucaccauguugguca

SEQ ID NO: 533342 - RNA, 32 nt, Human
uuaguagagacaggguuucaccauguuggucg

SEQ ID NO: 533343 - RNA, 32 nt, Human
uuaguagagacaggguuucaccauguugguua

SEQ ID NO: 533344 - RNA, 32 nt, Human
uuaguagagacaggguuucaccauguugucca

SEQ ID NO: 533345 - RNA, 32 nt, Human
uuaguagagacaggguuucaccauguuugcca

SEQ ID NO: 533346 - RNA, 32 nt, Human
uuaguagagacaggguuucaccguguuaacca

SEQ ID NO: 533347 - RNA, 32 nt, Human
uuaguagagacaggguuucaccguguuagcca

SEQ ID NO: 533348 - RNA, 32 nt, Human
uuaguagagacaggguuucaccguguuggcga

SEQ ID NO: 533349 - RNA, 32 nt, Human
uuaguagagacaggguuucaccguguugguca

SEQ ID NO: 533350 - RNA, 32 nt, Human
uuaguagagacaggguuucacuaugcugguca

SEQ ID NO: 533351 - RNA, 32 nt, Human
uuaguagagacaggguuucacuauguuggcca

SEQ ID NO: 533352 - RNA, 32 nt, Human
uuaguagagacaggguuucacuguguuagcca

SEQ ID NO: 533353 - RNA, 32 nt, Human
uuaguagagacaggguuucacuguguugccca

SEQ ID NO: 533354 - RNA, 32 nt, Human
uuaguagagacaggguuucauaauguaaguca

SEQ ID NO: 533355 - RNA, 32 nt, Human
uuaguagagacaggguuucaucauguuggcca

SEQ ID NO: 533356 - RNA, 32 nt, Human
uuaguagagacaggguuucaucauuguuggcc

SEQ ID NO: 533357 - RNA, 32 nt, Human
uuaguagagacaggguuucauuauguuggcca

SEQ ID NO: 533358 - RNA, 32 nt, Human
uuaguagagacaggguuuccacauguuggcca

SEQ ID NO: 533359 - RNA, 32 nt, Human
uuaguagagacaggguuucgcaauguuggcca

SEQ ID NO: 533360 - RNA, 32 nt, Human
uuaguagagacaggguuucgccauguuggcca

SEQ ID NO: 533361 - RNA, 32 nt, Human
uuaguagagacaggguuucgccauguuggcua

SEQ ID NO: 533362 - RNA, 32 nt, Human
uuaguagagacaggguuucuccaugucgguca

SEQ ID NO: 533363 - RNA, 32 nt, Human
uuaguagagacaggguuucuccauguugguca

SEQ ID NO: 533364 - RNA, 32 nt, Human
uuaguagagacaggguuucuccauguuggucg

SEQ ID NO: 533365 - RNA, 32 nt, Human
uuaguagagacaggguuucuccauguugguua

SEQ ID NO: 533366 - RNA, 32 nt, Human
uuaguagagacaggguuucuucauguugguca

SEQ ID NO: 533367 - RNA, 32 nt, Human
uuaguagagacaggguuuuaccauguuggcca

SEQ ID NO: 533368 - RNA, 32 nt, Human
uuaguagagacaggguuuuaccauguugguca

SEQ ID NO: 533369 - RNA, 32 nt, Human
uuaguagagacaggguuuuaccguguuagcca

SEQ ID NO: 533370 - RNA, 32 nt, Human
uuaguagagacaggguuuugccauguuagaca

SEQ ID NO: 533371 - RNA, 32 nt, Human
uuaguagagacaggguuuugccauguugccca

SEQ ID NO: 533372 - RNA, 32 nt, Human
uuaguagagacaggguuuugccauguuggcca

SEQ ID NO: 533373 - RNA, 32 nt, Human
uuaguagagacaggguuuugccguguuggcca

SEQ ID NO: 533374 - RNA, 32 nt, Human
uuaguagagacagguuucaccauauuggccag

SEQ ID NO: 533375 - RNA, 32 nt, Human
uuaguagagacagguuuucaccauguuagcca

SEQ ID NO: 533376 - RNA, 32 nt, Human
uuaguagagacagguuuucaccauguuggcca

SEQ ID NO: 533377 - RNA, 32 nt, Human
uuaguagagacagguuuucaccauguuggcga

SEQ ID NO: 533378 - RNA, 32 nt, Human
uuaguagagacaguguuuaccauguuggccag

SEQ ID NO: 533379 - RNA, 32 nt, Human
uuaguagagacaguguuucaccauguugacca

SEQ ID NO: 533380 - RNA, 32 nt, Human
uuaguagagacaguguuucaccauguuggcca

SEQ ID NO: 533381 - RNA, 32 nt, Human
uuaguagagacaguguuucgccauguuggcca

SEQ ID NO: 533382 - RNA, 32 nt, Human
uuaguagagacaguguuuugccauguuggcca

SEQ ID NO: 533383 - RNA, 32 nt, Human
uuaguagagacgagguuucaacauguuggcca

SEQ ID NO: 533384 - RNA, 32 nt, Human
uuaguagagacgggguucaccauguuggccag

SEQ ID NO: 533385 - RNA, 32 nt, Human
uuaguagagacggguuucaccauauugaccag

SEQ ID NO: 533386 - RNA, 32 nt, Human
uuaguagagacggguuucaccgugucggccag

SEQ ID NO: 533387 - RNA, 32 nt, Human
uuaguagagacggguuucaucauguuagccag

SEQ ID NO: 533388 - RNA, 32 nt, Human
uuaguagagacugguuucuccauguuggucag

SEQ ID NO: 533389 - RNA, 32 nt, Human
uuaguagagacugucccuucugccuucgggcg

SEQ ID NO: 533390 - RNA, 32 nt, Human
uuaguagagagagguuucaccauguuagccag

SEQ ID NO: 533391 - RNA, 32 nt, Human
uuaguagagagggguuucacaguguugggcag

SEQ ID NO: 533392 - RNA, 32 nt, Human
uuaguagagauagggucucaccauguuggcca

SEQ ID NO: 533393 - RNA, 32 nt, Human
uuaguagagaugaguuucaccauguuggucag

SEQ ID NO: 533394 - RNA, 32 nt, Human
uuaguagagaugggguuucaccauggccaggc

SEQ ID NO: 533395 - RNA, 32 nt, Human
uuaguagagaugggguuucaccauggcuaggc

SEQ ID NO: 533396 - RNA, 32 nt, Human
uuaguagagaugggguuucaccuuguugggug

SEQ ID NO: 533397 - RNA, 32 nt, Human
uuaguagagauggguuucaccauguuggccau

SEQ ID NO: 533398 - RNA, 32 nt, Human
uuaguagagauggguuucuccauguuggucgg

SEQ ID NO: 533399 - RNA, 32 nt, Human
uuaguagagcuggguuucaccauguuggccag

SEQ ID NO: 533400 - RNA, 32 nt, Human
uuaguagaguaggguuuggccauguuggccag

SEQ ID NO: 533401 - RNA, 32 nt, Human
uuaguagaucccuagacauggaaucagggcag

SEQ ID NO: 533402 - RNA, 32 nt, Human
uuaguagcauugaggucucacuauguugcaca

SEQ ID NO: 533403 - RNA, 32 nt, Human
uuaguagcgacaggguuguaccauguuggcca

SEQ ID NO: 533404 - RNA, 32 nt, Human
uuaguagcggagcguguugauccugccugaag

SEQ ID NO: 533405 - RNA, 32 nt, Human
uuaguaggcaggaagaggcggagggagagcuc

SEQ ID NO: 533406 - RNA, 32 nt, Human
uuaguagggaugggguuucccauguuggccag

SEQ ID NO: 533407 - RNA, 32 nt, Human
uuaguaguuuauuacuucacuugaggguacuu

SEQ ID NO: 533408 - RNA, 32 nt, Human
uuaguauagcucccccuuccccuucugggaaa

SEQ ID NO: 533409 - RNA, 32 nt, Human
uuaguauauagugaauacagaaacaucagcau

SEQ ID NO: 533410 - RNA, 32 nt, Human
uuaguaucaggagcacugagcucacagacuga

SEQ ID NO: 533411 - RNA, 32 nt, Human
uuaguauccuguuaggggaaaauaguagcaga

SEQ ID NO: 533412 - RNA, 32 nt, Human
uuaguaucugauuuuagaugaucacucuuuca

SEQ ID NO: 533413 - RNA, 32 nt, Human
uuaguauggaauuaaggaauuaaguuugguga

SEQ ID NO: 533414 - RNA, 32 nt, Human
uuaguauucaucucuuugaaucauuugcucaa

SEQ ID NO: 533415 - RNA, 32 nt, Human
uuaguauuccucauucugcauccuggcuugaa

SEQ ID NO: 533416 - RNA, 32 nt, Human
uuaguauucucaccacauuucguuuagucuac

SEQ ID NO: 533417 - RNA, 32 nt, Human
uuaguauugagcuguugccucucugaguacuc

SEQ ID NO: 533418 - RNA, 32 nt, Human
uuaguauuuaacuacaucugccucggcucaca

SEQ ID NO: 533419 - RNA, 32 nt, Human
uuaguauuuagacucuggauaacucuacaaua

SEQ ID NO: 533420 - RNA, 32 nt, Human
uuaguauuuauagaauaugaccuauuuaucug

SEQ ID NO: 533421 - RNA, 32 nt, Human
uuaguauuugcuggauaugcagggagaugaga

SEQ ID NO: 533422 - RNA, 32 nt, Human
uuagucaaguagaggcaaugcaaagauucaca

SEQ ID NO: 533423 - RNA, 23 nt, Human
uuagucaaguauaggggcugcca

SEQ ID NO: 533424 - RNA, 32 nt, Human
uuagucacggcacugcagccugggcaacauag

SEQ ID NO: 533425 - RNA, 27 nt, Human
uuagucagcucagaaacacccaucuua

SEQ ID NO: 533426 - RNA, 32 nt, Human
uuagucaggacucagaaaauuugagcuuaguu

SEQ ID NO: 533427 - RNA, 32 nt, Human
uuagucaggaggaucucuugagccugggaggu

SEQ ID NO: 533428 - RNA, 32 nt, Human
uuagucaggcuauccugacaagacuugaccua

SEQ ID NO: 533429 - RNA, 32 nt, Human
uuagucaucuggaacaaagacuaaaaacagca

SEQ ID NO: 533430 - RNA, 32 nt, Human
uuagucaucuuccuacagcaccaucuagacau

SEQ ID NO: 533431 - RNA, 32 nt, Human
uuagucauuuugcuucauagcugguuccugcu

SEQ ID NO: 533432 - RNA, 32 nt, Human
uuaguccagaacagccccagcauugucaaacu

SEQ ID NO: 533433 - RNA, 32 nt, Human
uuaguccaggaguuuugagaccagccugggca

SEQ ID NO: 533434 - RNA, 32 nt, Human
uuaguccaguugguuucuuucuuucucuuacc

SEQ ID NO: 533435 - RNA, 22 nt, Human
uuaguccauucucacacugcua

SEQ ID NO: 533436 - RNA, 32 nt, Human
uuagucccacggucuccugcaucagcugguga

SEQ ID NO: 533437 - RNA, 32 nt, Human
uuagucccccugagccucaagguugccacaug

SEQ ID NO: 533438 - RNA, 32 nt, Human
uuagucccuaucuggguaagggucuucccuug

SEQ ID NO: 533439 - RNA, 32 nt, Human
uuagucccuccagaccucggcuuuagugcugu

SEQ ID NO: 533440 - RNA, 32 nt, Human
uuagucccugaacaggagugaugccuccaggc

SEQ ID NO: 533441 - RNA, 22 nt, Human
uuaguccguucucacacugcua

SEQ ID NO: 533442 - RNA, 32 nt, Human
uuaguccugaggcgcugggaauagcugauccu

SEQ ID NO: 533443 - RNA, 32 nt, Human
uuaguccuggagacccagccuccagggacuga

SEQ ID NO: 533444 - RNA, 32 nt, Human
uuaguccuggaguucaagucuaaauguugaug

SEQ ID NO: 533445 - RNA, 29 nt, Human
uuaguccuggcccagcccagagcugggac

SEQ ID NO: 533446 - RNA, 32 nt, Human
uuaguccuguaacuuuauugggugauauuuug

SEQ ID NO: 533447 - RNA, 32 nt, Human
uuaguccuuaucucccuacggggcuugccuug

SEQ ID NO: 533448 - RNA, 32 nt, Human
uuaguccuuugucuaaguagggccagggcacc

SEQ ID NO: 533449 - RNA, 32 nt, Human
uuagucgagacggguuucaccacguuggccag

SEQ ID NO: 533450 - RNA, 32 nt, Human
uuagucgaggguggguggggccugggaaucug

SEQ ID NO: 533451 - RNA, 32 nt, Human
uuagucgggaggcugaggcaggagaauaugga

SEQ ID NO: 533452 - RNA, 32 nt, Human
uuagucguuggaggcuggagcgcaauggcccu

SEQ ID NO: 533453 - RNA, 32 nt, Human
uuagucuaaagaaagaaagacaaaaguagucg

SEQ ID NO: 533454 - RNA, 32 nt, Human
uuagucuaacucugcauagacagggucuagau

SEQ ID NO: 533455 - RNA, 32 nt, Human
uuagucuauacccaccaccucccuucauaacc

SEQ ID NO: 533456 - RNA, 32 nt, Human
uuagucucacccaaugugauuuguagaagcac

SEQ ID NO: 533457 - RNA, 32 nt, Human
uuagucucauuucucucccucccuucuucccu

SEQ ID NO: 533458 - RNA, 21 nt, Human
uuagucuccaggaggcugcca

SEQ ID NO: 533459 - RNA, 32 nt, Human
uuagucuccagugucuccuauuacaaagaagc

SEQ ID NO: 533460 - RNA, 32 nt, Human
uuagucucccaaaaugcugggauuacaggagu

SEQ ID NO: 533461 - RNA, 32 nt, Human
uuagucucccaaagugcuaggauuacagcgug

SEQ ID NO: 533462 - RNA, 32 nt, Human
uuagucuccuaaagugcugggauuacaugugu

SEQ ID NO: 533463 - RNA, 32 nt, Human
uuagucucugcagucucuugucuugaauuaau

SEQ ID NO: 533464 - RNA, 32 nt, Human
uuagucucuuuucuacaaucuucuucagaaag

SEQ ID NO: 533465 - RNA, 32 nt, Human
uuagucucuuuuguccuugugagagcugggug

SEQ ID NO: 533466 - RNA, 32 nt, Human
uuagucuggaaagacuuuguuuaaaugaaagg

SEQ ID NO: 533467 - RNA, 32 nt, Human
uuagucugucucaaagcucuauauguuuacau

SEQ ID NO: 533468 - RNA, 22 nt, Human
uuagucuguucucaugcugcua

SEQ ID NO: 533469 - RNA, 26 nt, Human
uuagucuuacccagugaaucauucug

SEQ ID NO: 533470 - RNA, 32 nt, Human
uuagucuucaucugaauuucaggcugggaggg

SEQ ID NO: 533471 - RNA, 32 nt, Human
uuagucuucccuuuguuauaugacuuuauagg

SEQ ID NO: 533472 - RNA, 32 nt, Human
uuagucuuccuaaaggacaaaauaaacaguau

SEQ ID NO: 533473 - RNA, 32 nt, Human
uuagucuucucccccuucccuggggcuucuag

SEQ ID NO: 533474 - RNA, 32 nt, Human
uuagucuucuuccagaaacagagaaggggaug

SEQ ID NO: 533475 - RNA, 32 nt, Human
uuagucuugugagcguuuuuacaccggguaga

SEQ ID NO: 533476 - RNA, 32 nt, Human
uuagucuugugcugacuuucuccuguccucuu

SEQ ID NO: 533477 - RNA, 32 nt, Human
uuagucuuguuucccaggcuggagugcaaugg

SEQ ID NO: 533478 - RNA, 32 nt, Human
uuagugaaccaaaaauagaaauuagauuugug

SEQ ID NO: 533479 - RNA, 32 nt, Human
uuagugaacugcugcugcuguucagacuuuuu

SEQ ID NO: 533480 - RNA, 32 nt, Human
uuagugaagguaauuccaaaauacugguauca

SEQ ID NO: 533481 - RNA, 32 nt, Human
uuagugacauaaaauauuuucucuauuuuccc

SEQ ID NO: 533482 - RNA, 32 nt, Human
uuagugagacuagacauaguaccgaauuuagu

SEQ ID NO: 533483 - RNA, 32 nt, Human
uuagugagagcugacuggcaagauaaaaaccc

SEQ ID NO: 533484 - RNA, 32 nt, Human
uuagugagugcggcuaaguccccagcccccuc

SEQ ID NO: 533485 - RNA, 32 nt, Human
uuagugaucccuccugcugucucuuuccuuuu

SEQ ID NO: 533486 - RNA, 32 nt, Human
uuagugauccugcuugcccuguggaaagaccu

SEQ ID NO: 533487 - RNA, 32 nt, Human
uuagugaucuguugcaagauaacuuggaauua

SEQ ID NO: 533488 - RNA, 32 nt, Human
uuagugaugacucugaaagcauugaagaaagu

SEQ ID NO: 533489 - RNA, 32 nt, Human
uuagugauucuucacaauuccuccaggaugac

SEQ ID NO: 533490 - RNA, 32 nt, Human
uuagugcagagcagggguggucaggcugaacg

SEQ ID NO: 533491 - RNA, 32 nt, Human
uuagugcaucuucuccaagaagggccguucau

SEQ ID NO: 533492 - RNA, 32 nt, Human
uuagugcaugcccuacccucugggggaacguc

SEQ ID NO: 533493 - RNA, 32 nt, Human
uuagugcauggucggggcaggaacuggugcau

SEQ ID NO: 533494 - RNA, 32 nt, Human
uuagugccauuagguauguauguauguaacuu

SEQ ID NO: 533495 - RNA, 32 nt, Human
uuagugcccuuauuuaaaaaggccccagagag

SEQ ID NO: 533496 - RNA, 32 nt, Human
uuagugccuagaguuaagagacaaauguuuac

SEQ ID NO: 533497 - RNA, 32 nt, Human
uuagugccucuuaguccaucuguucccucucc

SEQ ID NO: 533498 - RNA, 32 nt, Human
uuagugccuugaucuuggacuucccagugucu

SEQ ID NO: 533499 - RNA, 32 nt, Human
uuagugccuuguaaucuaacuuugucacugug

SEQ ID NO: 533500 - RNA, 32 nt, Human
uuagugcugcaccacucggacauggcuaauuc

SEQ ID NO: 533501 - RNA, 32 nt, Human
uuagugcugcugcaaagaugagccgaagacca

SEQ ID NO: 533502 - RNA, 32 nt, Human
uuagugcuggacugguacccuuguagaagcca

SEQ ID NO: 533503 - RNA, 32 nt, Human
uuaguggaaauggauucaugaaauauauuaaa

SEQ ID NO: 533504 - RNA, 32 nt, Human
uuaguggaauuccacaccaacagggcuuguga

SEQ ID NO: 533505 - RNA, 32 nt, Human
uuaguggagacaggauuuuaccauguuggcca

SEQ ID NO: 533506 - RNA, 32 nt, Human
uuaguggagacagguuucaccauguuggccag

SEQ ID NO: 533507 - RNA, 32 nt, Human
uuaguggauacuugggcuacuuccaccuuuug

SEQ ID NO: 533508 - RNA, 32 nt, Human
uuaguggaucucaaacuugucuuaaaucaaca

SEQ ID NO: 533509 - RNA, 32 nt, Human
uuaguggcaccagaguaacucuagucaguuac

SEQ ID NO: 533510 - RNA, 32 nt, Human
uuaguggcacggugcuugggccuguguccccg

SEQ ID NO: 533511 - RNA, 32 nt, Human
uuaguggcaggaggaggaguuaaggugaucuu

SEQ ID NO: 533512 - RNA, 32 nt, Human
uuaguggcugccacuucugccgcagcaggccc

SEQ ID NO: 533513 - RNA, 32 nt, Human
uuaguggcuguuccagaaucucugccugagaa

SEQ ID NO: 533514 - RNA, 32 nt, Human
uuaguggcuguuuucugucuucccaggaagcc

SEQ ID NO: 533515 - RNA, 32 nt, Human
uuaguggcuuccaacagccaucaggaguguuu

SEQ ID NO: 533516 - RNA, 32 nt, Human
uuaguggcuugcccucugccugccucagcugc

SEQ ID NO: 533517 - RNA, 32 nt, Human
uuagugggagaaucagagagagcuguaguguc

SEQ ID NO: 533518 - RNA, 32 nt, Human
uuaguggguuagcgggucugaccucagcccca

SEQ ID NO: 533519 - RNA, 32 nt, Human
uuagugguagagcgaccuuuucaauuacaaag

SEQ ID NO: 533520 - RNA, 31 nt, Human
uuaguggugacagagcacaaagacugaagau

SEQ ID NO: 533521 - RNA, 32 nt, Human
uuaguggugacugguuucugccuaccacuucc

SEQ ID NO: 533522 - RNA, 32 nt, Human
uuaguggugcuugcagucacaggaagcagcag

SEQ ID NO: 533523 - RNA, 32 nt, Human
uuagugguggccauuuagccaccaucuuugca

SEQ ID NO: 533524 - RNA, 32 nt, Human
uuagugguucagaaagguaaccucaagaagaa

SEQ ID NO: 533525 - RNA, 32 nt, Human
uuaguguaaaaaugagaacauguugguauuua

SEQ ID NO: 533526 - RNA, 32 nt, Human
uuaguguaaaaguacaugcagaaagaugaaac

SEQ ID NO: 533527 - RNA, 32 nt, Human
uuaguguaauaagcuggcuacacagaacccca

SEQ ID NO: 533528 - RNA, 32 nt, Human
uuaguguagcacucaugcugaaguaaacauga

SEQ ID NO: 533529 - RNA, 32 nt, Human
uuagugucaaaagugagaugcugagaguaggu

SEQ ID NO: 533530 - RNA, 32 nt, Human
uuagugucucaaagugcugggauuacagguau

SEQ ID NO: 533531 - RNA, 32 nt, Human
uuagugucuccagucaagcucuggguacugaa

SEQ ID NO: 533532 - RNA, 32 nt, Human
uuaguguguuccccuuuguggguggguuccua

SEQ ID NO: 533533 - RNA, 32 nt, Human
uuaguguuaaaagaaaaguuugcugaaaaagu

SEQ ID NO: 533534 - RNA, 32 nt, Human
uuaguguucaaaacauugaaacacucuucacc

SEQ ID NO: 533535 - RNA, 32 nt, Human
uuaguguucauagcuuccaagagacaugcuga

SEQ ID NO: 533536 - RNA, 32 nt, Human
uuaguguuccaaguagcugggauuacagacgc

SEQ ID NO: 533537 - RNA, 32 nt, Human
uuaguguugggcugcaagguugguucaguaua

SEQ ID NO: 533538 - RNA, 32 nt, Human
uuaguguuugacauugcuuccucugccacaaa

SEQ ID NO: 533539 - RNA, 32 nt, Human
uuaguuaaagugugacuuucagaaagggaaaa

SEQ ID NO: 533540 - RNA, 32 nt, Human
uuaguuaacccucccugccuuuucuuaacaaa

SEQ ID NO: 533541 - RNA, 32 nt, Human
uuaguuaaccugaaagauuccaaaaauuguuc

SEQ ID NO: 533542 - RNA, 32 nt, Human
uuaguuaaguauauggauaaaaaguuaugaac

SEQ ID NO: 533543 - RNA, 32 nt, Human
uuaguuaccaggagaaaugugugacaccuaua

SEQ ID NO: 533544 - RNA, 32 nt, Human
uuaguuagagucuaaugaaacucucaucuagu

SEQ ID NO: 533545 - RNA, 32 nt, Human
uuaguuauuccuuucuuuacccaccuaaacua

SEQ ID NO: 533546 - RNA, 21 nt, Human
uuaguuauuucuggguuguca

SEQ ID NO: 533547 - RNA, 32 nt, Human
uuaguucaagccccagccuaggaaagccaguu

SEQ ID NO: 533548 - RNA, 32 nt, Human
uuaguucacugcaacuuccgcuucccagguuc

SEQ ID NO: 533549 - RNA, 32 nt, Human
uuaguucagagcagagccugaugccugagauc

SEQ ID NO: 533550 - RNA, 32 nt, Human
uuaguucauauguacacuagccagugguugug

SEQ ID NO: 533551 - RNA, 22 nt, Human
uuaguucauugucacacugcua

SEQ ID NO: 533552 - RNA, 32 nt, Human
uuaguuccccuccccuccccucccucuuuuua

SEQ ID NO: 533553 - RNA, 32 nt, Human
uuaguuccgcccuccuguccaucaggagaagg

SEQ ID NO: 533554 - RNA, 21 nt, Human
uuaguuccuuuuucaggcuca

SEQ ID NO: 533555 - RNA, 32 nt, Human
uuaguucggucugcaagacgguuuucccagug

SEQ ID NO: 533556 - RNA, 32 nt, Human
uuaguucuacaaaaaucagcugaaaucaugaa

SEQ ID NO: 533557 - RNA, 32 nt, Human
uuaguucucacaccugcacuuaccagcaucca

SEQ ID NO: 533558 - RNA, 32 nt, Human
uuaguucucaucuagaaugaaaguuccauaua

SEQ ID NO: 533559 - RNA, 32 nt, Human
uuaguucuuccagguugaauccugggcagaaa

SEQ ID NO: 533560 - RNA, 32 nt, Human
uuaguucuugcuuagggaaaaugccagguaug

SEQ ID NO: 533561 - RNA, 32 nt, Human
uuaguucuuuucuccccuugaggucaguaaua

SEQ ID NO: 533562 - RNA, 32 nt, Human
uuaguugacccugauggggacccguaggguaa

SEQ ID NO: 533563 - RNA, 32 nt, Human
uuaguugacuaauucuuccucccauuccccuc

SEQ ID NO: 533564 - RNA, 32 nt, Human
uuaguugaguuugucugaagaccugggauuuu

SEQ ID NO: 533565 - RNA, 32 nt, Human
uuaguugcugcacuccagccuaggcaacauag

SEQ ID NO: 533566 - RNA, 32 nt, Human
uuaguuggaagacuucacgaagacugcugaua

SEQ ID NO: 533567 - RNA, 32 nt, Human
uuaguuggaguucucauuuuuauucuccagua

SEQ ID NO: 533568 - RNA, 32 nt, Human
uuaguuggaugggguuucaccauguuagccag

SEQ ID NO: 533569 - RNA, 32 nt, Human
uuaguugggaaaauacuuguuuuuccaaauuc

SEQ ID NO: 533570 - RNA, 32 nt, Human
uuaguugggggcuguccagagcugcagcaggg

SEQ ID NO: 533571 - RNA, 32 nt, Human
uuaguuggucccuauguuggaaguaaaaagug

SEQ ID NO: 533572 - RNA, 32 nt, Human
uuaguugguuuggguggggccugagauucugc

SEQ ID NO: 533573 - RNA, 23 nt, Human
uuaguuguucagcaacugucuua

SEQ ID NO: 533574 - RNA, 32 nt, Human
uuaguuuacagaauggaaccaaaauguauaaa

SEQ ID NO: 533575 - RNA, 32 nt, Human
uuaguuuaccccuuggcuuuguguucuugcau

SEQ ID NO: 533576 - RNA, 32 nt, Human
uuaguuuagacuauuguaggaauggaaggaaa

SEQ ID NO: 533577 - RNA, 32 nt, Human
uuaguuuagcgugagauugcagauguuaccau

SEQ ID NO: 533578 - RNA, 32 nt, Human
uuaguuucaaagcuuauucuuaauuagagaca

SEQ ID NO: 533579 - RNA, 32 nt, Human
uuaguuucuccaagcaggacauggacaaggau

SEQ ID NO: 533580 - RNA, 32 nt, Human
uuaguuugaguuuuuaaaaacuaggaagacag

SEQ ID NO: 533581 - RNA, 31 nt, Human
uuaguuugccucuccccaucuuugucucccu

SEQ ID NO: 533582 - RNA, 32 nt, Human
uuaguuugccuggagcuugaaaggagaaagca

SEQ ID NO: 533583 - RNA, 32 nt, Human
uuaguuugccuguaauacauggauauuuuuaa

SEQ ID NO: 533584 - RNA, 32 nt, Human
uuaguuugcucaucuaugaucugagaucaugc

SEQ ID NO: 533585 - RNA, 32 nt, Human
uuaguuuggaaagaauagaagaaggaauagau

SEQ ID NO: 533586 - RNA, 32 nt, Human
uuaguuuggccugggcuucucagcuuguccag

SEQ ID NO: 533587 - RNA, 32 nt, Human
uuaguuuggggaggggaagcauuuuuaagugu

SEQ ID NO: 533588 - RNA, 32 nt, Human
uuaguuuuaguuuucuggaauagcuaguauug

SEQ ID NO: 533589 - RNA, 32 nt, Human
uuaguuuuccacucugccccggggagcacccu

SEQ ID NO: 533590 - RNA, 32 nt, Human
uuaguuuucccuuuuuccuuuuuaauaugagu

SEQ ID NO: 533591 - RNA, 32 nt, Human
uuaguuuucucagagaaguggagggaggagga

SEQ ID NO: 533592 - RNA, 32 nt, Human
uuaguuuugaugaugcacaaaauaaacagcag

SEQ ID NO: 533593 - RNA, 32 nt, Human
uuaguuuugcagaagaacacuguuguaguuua

SEQ ID NO: 533594 - RNA, 31 nt, Human
uuaguuuuggauuucuuuacuguuucuaaua

SEQ ID NO: 533595 - RNA, 32 nt, Human
uuaguuuugugcuuaguuaaaucuuuuccagg

SEQ ID NO: 533596 - RNA, 32 nt, Human
uuaguuuuguggcuuacugcugcuccacccag

SEQ ID NO: 533597 - RNA, 32 nt, Human
uuaguuuuucugagguagugcaucccauuaaa

SEQ ID NO: 533598 - RNA, 32 nt, Human
uuaguuuuugcauauguaguacacuuaugcau

SEQ ID NO: 533599 - RNA, 32 nt, Human
uuauaaaaagccuuaaguggaaaguguuccag

SEQ ID NO: 533600 - RNA, 32 nt, Human
uuauaaaaaguuaagaaaaagcauuagaggcu

SEQ ID NO: 533601 - RNA, 32 nt, Human
uuauaaaaauauucauguacuaccacaguaua

SEQ ID NO: 533602 - RNA, 32 nt, Human
uuauaaaacccaagaguaggaaccugacaacc

SEQ ID NO: 533603 - RNA, 32 nt, Human
uuauaaaacucauguguacuacuuaaguuuau

SEQ ID NO: 533604 - RNA, 32 nt, Human
uuauaaaacuuguuggaauuuuuacggcuuuu

SEQ ID NO: 533605 - RNA, 32 nt, Human
uuauaaaaggaaaauaaagggcauaaugauug

SEQ ID NO: 533606 - RNA, 32 nt, Human
uuauaaaagggaauagagaagagaugggacua

SEQ ID NO: 533607 - RNA, 32 nt, Human
uuauaaaauaaggaaguaacaugugaggcucu

SEQ ID NO: 533608 - RNA, 32 nt, Human
uuauaaaauagggaaugaaugaaugaauaugg

SEQ ID NO: 533609 - RNA, 32 nt, Human
uuauaaaauuccugccucucccuaacacagga

SEQ ID NO: 533610 - RNA, 32 nt, Human
uuauaaacacaugcacuuuuguuuuguuuuug

SEQ ID NO: 533611 - RNA, 32 nt, Human
uuauaaacagaagugacugauguucccuccgg

SEQ ID NO: 533612 - RNA, 32 nt, Human
uuauaaaccagcaaugucaucugugaggaagc

SEQ ID NO: 533613 - RNA, 32 nt, Human
uuauaaaccccuccaaucuacuagucaagaga

SEQ ID NO: 533614 - RNA, 32 nt, Human
uuauaaacccucuccagccucucccaaaggaa

SEQ ID NO: 533615 - RNA, 32 nt, Human
uuauaaacucacuguaaucaaaucuuauaaaa

SEQ ID NO: 533616 - RNA, 32 nt, Human
uuauaaagaagagguuuaauuggcucacgguu

SEQ ID NO: 533617 - RNA, 32 nt, Human
uuauaaagaauaaagaaaucaccagaacugcc

SEQ ID NO: 533618 - RNA, 32 nt, Human
uuauaaagacaggguuuuuccauguugcccag

SEQ ID NO: 533619 - RNA, 32 nt, Human
uuauaaagagcccaguugucuccuugugacau

SEQ ID NO: 533620 - RNA, 32 nt, Human
uuauaaagaguuauacccugaagaauuugaaa

SEQ ID NO: 533621 - RNA, 32 nt, Human
uuauaaagaugguaguaagucaauacauuuau

SEQ ID NO: 533622 - RNA, 32 nt, Human
uuauaaagauuuuaccuagaaauaauguauuu

SEQ ID NO: 533623 - RNA, 32 nt, Human
uuauaaagugugccacauggacuuaccgagca

SEQ ID NO: 533624 - RNA, 32 nt, Human
uuauaaauagauuccccacgcaggugguggca

SEQ ID NO: 533625 - RNA, 32 nt, Human
uuauaaauaugagaaugcagcacacaaagaga

SEQ ID NO: 533626 - RNA, 32 nt, Human
uuauaaauggcagaagagugacaaaauucauu

SEQ ID NO: 533627 - RNA, 32 nt, Human
uuauaaauggugcugaagcaggacccgaagcc

SEQ ID NO: 533628 - RNA, 32 nt, Human
uuauaaauguacaaauaguuacugaaaugacg

SEQ ID NO: 533629 - RNA, 32 nt, Human
uuauaaauuauaggagguuuugguuuucuuuu

SEQ ID NO: 533630 - RNA, 32 nt, Human
uuauaacaaaaacuuuguggauuucauaaaaa

SEQ ID NO: 533631 - RNA, 32 nt, Human
uuauaacacuaaaacuggacagucuccugaga

SEQ ID NO: 533632 - RNA, 32 nt, Human
uuauaaccaaagccaauuaagaucuuaaaacc

SEQ ID NO: 533633 - RNA, 32 nt, Human
uuauaaccaguuuuugauugguaauuguuuuc

SEQ ID NO: 533634 - RNA, 32 nt, Human
uuauaaccuugaguugaugaaacucugaggca

SEQ ID NO: 533635 - RNA, 32 nt, Human
uuauaaccuuuuaaauagaggcugcuuuucca

SEQ ID NO: 533636 - RNA, 32 nt, Human
uuauaacggugaauuauaccuuugugcaugcc

SEQ ID NO: 533637 - RNA, 32 nt, Human
uuauaacucagccuuuaggaacaccggagaac

SEQ ID NO: 533638 - RNA, 32 nt, Human
uuauaacugaucauauuacuguauuuguauug

SEQ ID NO: 533639 - RNA, 32 nt, Human
uuauaacugauuuuuaaaaugcuguuuuucag

SEQ ID NO: 533640 - RNA, 32 nt, Human
uuauaacuuauccauaugcaugauggaaaaau

SEQ ID NO: 533641 - RNA, 32 nt, Human
uuauaagaaaaauuauguacacagcuuauuuu

SEQ ID NO: 533642 - RNA, 32 nt, Human
uuauaagaaaugacauuuauggaacacuuauu

SEQ ID NO: 533643 - RNA, 32 nt, Human
uuauaagaucuacccuuauggccaggugcagu

SEQ ID NO: 533644 - RNA, 32 nt, Human
uuauaagcaaaaguugguugccuagggaacaa

SEQ ID NO: 533645 - RNA, 32 nt, Human
uuauaagcacacacaagauacaugguggaaga

SEQ ID NO: 533646 - RNA, 32 nt, Human
uuauaagcagaggauauuacccacuucagaga

SEQ ID NO: 533647 - RNA, 32 nt, Human
uuauaagcagcuguauccccuuugccauggug

SEQ ID NO: 533648 - RNA, 32 nt, Human
uuauaagcagcuucccccuuugcucaguauca

SEQ ID NO: 533649 - RNA, 32 nt, Human
uuauaagcccaagucauuuuacauuugcuuuu

SEQ ID NO: 533650 - RNA, 32 nt, Human
uuauaagccuuugccagguguaacuguuguga

SEQ ID NO: 533651 - RNA, 32 nt, Human
uuauaagcugagaccgguggcucucuucuuaa

SEQ ID NO: 533652 - RNA, 32 nt, Human
uuauaagcuuuacauccucccauguuguccug

SEQ ID NO: 533653 - RNA, 32 nt, Human
uuauaaggaggcauuaacacagcaguuaaaga

SEQ ID NO: 533654 - RNA, 32 nt, Human
uuauaaggagggcuggccaaucucugcccagg

SEQ ID NO: 533655 - RNA, 31 nt, Human
uuauaaggcaguagagaaaaacuguuggguu

SEQ ID NO: 533656 - RNA, 32 nt, Human
uuauaagggcccugcccuguacugaagaaaag

SEQ ID NO: 533657 - RNA, 32 nt, Human
uuauaagggguuuccccuuuugcuuagcucuc

SEQ ID NO: 533658 - RNA, 32 nt, Human
uuauaaggucccuagauaucccagaaccugcc

SEQ ID NO: 533659 - RNA, 32 nt, Human
uuauaagucaagccauggaauuugaacuuuau

SEQ ID NO: 533660 - RNA, 32 nt, Human
uuauaaguccccaaaaguugaauauuggaaau

SEQ ID NO: 533661 - RNA, 32 nt, Human
uuauaagucuguguccuuuucuugaguacuga

SEQ ID NO: 533662 - RNA, 32 nt, Human
uuauaagugauggauagcagaaagggagaacu

SEQ ID NO: 533663 - RNA, 32 nt, Human
uuauaaguggguuuuaaaaaguugcagugggc

SEQ ID NO: 533664 - RNA, 32 nt, Human
uuauaauaaaaaggaaggacaggaggaagaca

SEQ ID NO: 533665 - RNA, 32 nt, Human
uuauaauaagagacuugaagcugggugugacg

SEQ ID NO: 533666 - RNA, 32 nt, Human
uuauaauaauugcaccuaccucccagggguaa

SEQ ID NO: 533667 - RNA, 32 nt, Human
uuauaauacuguuuuaaaaugugaggcaauaa

SEQ ID NO: 533668 - RNA, 32 nt, Human
uuauaauaggccuucuauauuuccuugucuuu

SEQ ID NO: 533669 - RNA, 32 nt, Human
uuauaauagguggggaaauucaggaaacaucc

SEQ ID NO: 533670 - RNA, 32 nt, Human
uuauaauauucagcaaaagugaaagacuugug

SEQ ID NO: 533671 - RNA, 32 nt, Human
uuauaauccccgaaguuaaaucuugcuguuau

SEQ ID NO: 533672 - RNA, 32 nt, Human
uuauaauccucaauuaugaaccaccuuguuua

SEQ ID NO: 533673 - RNA, 32 nt, Human
uuauaaucgaugucauuguauguuuucuuuaa

SEQ ID NO: 533674 - RNA, 32 nt, Human
uuauaaucuuccauacuucuucauucaauaca

SEQ ID NO: 533675 - RNA, 32 nt, Human
uuauaaugcauuuuacucccaguauuauguuc

SEQ ID NO: 533676 - RNA, 32 nt, Human
uuauaaugggugggggcuaccacccacccucu

SEQ ID NO: 533677 - RNA, 32 nt, Human
uuauaaugucuucauuuauuuagcaugcaaau

SEQ ID NO: 533678 - RNA, 32 nt, Human
uuauaauucagucugcuuuuggauuuucauau

SEQ ID NO: 533679 - RNA, 32 nt, Human
uuauaauucugcaauccucuugcucaggaagu

SEQ ID NO: 533680 - RNA, 32 nt, Human
uuauaauucugccucuagccaaaugcuauguu

SEQ ID NO: 533681 - RNA, 32 nt, Human
uuauaauuucuuuccaaagauaccaaauaaac

SEQ ID NO: 533682 - RNA, 32 nt, Human
uuauacaaagcccuccagccuguuuguggggc

SEQ ID NO: 533683 - RNA, 32 nt, Human
uuauacaaauaccauguaauguguacauauuu

SEQ ID NO: 533684 - RNA, 32 nt, Human
uuauacaaggggauguacacagcccugcuuua

SEQ ID NO: 533685 - RNA, 32 nt, Human
uuauacaaguuagaaaacaaaaauagagugug

SEQ ID NO: 533686 - RNA, 32 nt, Human
uuauacaauaaauaaaugaaauauugugcuga

SEQ ID NO: 533687 - RNA, 32 nt, Human
uuauacaauacaauuuguuucuauuuugaggc

SEQ ID NO: 533688 - RNA, 32 nt, Human
uuauacaauucuuuacuuaauucuaccagccu

SEQ ID NO: 533689 - RNA, 32 nt, Human
uuauacacucccuuccauucaggauuuucugc

SEQ ID NO: 533690 - RNA, 32 nt, Human
uuauacacuuggauuucauuuguaacuuuagg

SEQ ID NO: 533691 - RNA, 32 nt, Human
uuauacagaccccagccccauucccaucuacu

SEQ ID NO: 533692 - RNA, 32 nt, Human
uuauacagagcugacucaaaaagacaaaaagu

SEQ ID NO: 533693 - RNA, 32 nt, Human
uuauacagcucuuuuccgggaacucacccagg

SEQ ID NO: 533694 - RNA, 32 nt, Human
uuauacaggagguagcuuggugggagugaaac

SEQ ID NO: 533695 - RNA, 32 nt, Human
uuauacaggggguucuagccagugcaugaaga

SEQ ID NO: 533696 - RNA, 32 nt, Human
uuauacagguucaucaguacugugucuugaga

SEQ ID NO: 533697 - RNA, 32 nt, Human
uuauacauaaucaagauccugccucuacggaa

SEQ ID NO: 533698 - RNA, 32 nt, Human
uuauacaucucuucagggaagagagaaccaau

SEQ ID NO: 533699 - RNA, 32 nt, Human
uuauacaugagacuaugguuggacuuccuuuu

SEQ ID NO: 533700 - RNA, 32 nt, Human
uuauacauguauccuaaaaagagaagcucaug

SEQ ID NO: 533701 - RNA, 32 nt, Human
uuauacauuccugaaacauuuucaucuguauc

SEQ ID NO: 533702 - RNA, 32 nt, Human
uuauaccaaacaguaaucagauuccauuggaa

SEQ ID NO: 533703 - RNA, 20 nt, Human
uuauaccaacaacuguuuca

SEQ ID NO: 533704 - RNA, 32 nt, Human
uuauaccaauguuugaaaguaauuggguguua

SEQ ID NO: 533705 - RNA, 32 nt, Human
uuauaccacauaccacacauagccacagaaac

SEQ ID NO: 533706 - RNA, 32 nt, Human
uuauaccacaugcaaaaauguccauaugcacu

SEQ ID NO: 533707 - RNA, 32 nt, Human
uuauaccacugcacuccagccugggugacaga

SEQ ID NO: 533708 - RNA, 32 nt, Human
uuauaccagcacuuugggaggcugaaguggga

SEQ ID NO: 533709 - RNA, 32 nt, Human
uuauaccaguauccccuucauuacaguaaacu

SEQ ID NO: 533710 - RNA, 32 nt, Human
uuauaccauacagacacagcaacuuaggaaga

SEQ ID NO: 533711 - RNA, 32 nt, Human
uuauaccauggaugcuaaaaaugguucuaacu

SEQ ID NO: 533712 - RNA, 32 nt, Human
uuauacccagugaggaugcugcagugaggcug

SEQ ID NO: 533713 - RNA, 32 nt, Human
uuauacccuccccuuguuuucuugcuuuauuc

SEQ ID NO: 533714 - RNA, 32 nt, Human
uuauacccuccugacuuguucuccccuuccuu

SEQ ID NO: 533715 - RNA, 32 nt, Human
uuauaccuagaaaaacaccacaggggaacagg

SEQ ID NO: 533716 - RNA, 18 nt, Human
uuauaccuauugucuaua

SEQ ID NO: 533717 - RNA, 32 nt, Human
uuauaccuguaauccuagcacuuugggaggcu

SEQ ID NO: 533718 - RNA, 32 nt, Human
uuauaccuguugcuauuuugcaaagaaauaau

SEQ ID NO: 533719 - RNA, 32 nt, Human
uuauacggagucucgcucugucacccaggcug

SEQ ID NO: 533720 - RNA, 32 nt, Human
uuauacuaaugagcuaauggggucauugccau

SEQ ID NO: 533721 - RNA, 32 nt, Human
uuauacuaaugugccaaguaaauguucauugc

SEQ ID NO: 533722 - RNA, 32 nt, Human
uuauacuacagaaaugagaaucucaucaauaa

SEQ ID NO: 533723 - RNA, 32 nt, Human
uuauacuacauaguacccaccucuccaaaugc

SEQ ID NO: 533724 - RNA, 32 nt, Human
uuauacuacuuccugucauaaccuucuaacuu

SEQ ID NO: 533725 - RNA, 32 nt, Human
uuauacuauuucaacuagaccccacaccaggg

SEQ ID NO: 533726 - RNA, 32 nt, Human
uuauacucaacuuacuguuuagaaaauguggc

SEQ ID NO: 533727 - RNA, 31 nt, Human
uuauacucacucaaggcagugcaagaucuug

SEQ ID NO: 533728 - RNA, 32 nt, Human
uuauacucauaaggucaguguacagacccaag

SEQ ID NO: 533729 - RNA, 32 nt, Human
uuauacuccaacaauucaugagcaacaguaua

SEQ ID NO: 533730 - RNA, 32 nt, Human
uuauacucuccaaagcccucaggcuggaauga

SEQ ID NO: 533731 - RNA, 32 nt, Human
uuauacugcacuuuaguguauuuucugucacu

SEQ ID NO: 533732 - RNA, 32 nt, Human
uuauacugcagggcaucuugugaauauguaug

SEQ ID NO: 533733 - RNA, 32 nt, Human
uuauacugcauggagucuuucuuuaauuuagg

SEQ ID NO: 533734 - RNA, 32 nt, Human
uuauacugcuuaaaauacaguuagugccuauu

SEQ ID NO: 533735 - RNA, 32 nt, Human
uuauacugggauaguccucucugcuuuucaga

SEQ ID NO: 533736 - RNA, 32 nt, Human
uuauacugggggugaggggacaagaaagccau

SEQ ID NO: 533737 - RNA, 32 nt, Human
uuauacugugugccaggcacugugggaaaugc

SEQ ID NO: 533738 - RNA, 32 nt, Human
uuauacuguugauuacuuucaguauuaauaua

SEQ ID NO: 533739 - RNA, 32 nt, Human
uuauacuuaaugaucauuuccaaaggagacca

SEQ ID NO: 533740 - RNA, 32 nt, Human
uuauacuuaauuauaggguuguaauguuuaua

SEQ ID NO: 533741 - RNA, 32 nt, Human
uuauacuuagucaaauguaauguggcuucugg

SEQ ID NO: 533742 - RNA, 32 nt, Human
uuauacuucauuugugaguuaugaauguuuuu

SEQ ID NO: 533743 - RNA, 32 nt, Human
uuauacuucucuucauucuuuuaaggccuugc

SEQ ID NO: 533744 - RNA, 32 nt, Human
uuauacuugccugguacucaugauagaccccu

SEQ ID NO: 533745 - RNA, 32 nt, Human
uuauacuugcuuacuccagccaucugcaguac

SEQ ID NO: 533746 - RNA, 32 nt, Human
uuauacuuucugcacauucaguguauugguaa

SEQ ID NO: 533747 - RNA, 32 nt, Human
uuauacuuuggccauaccacagagcuagauug

SEQ ID NO: 533748 - RNA, 32 nt, Human
uuauagaaaaaugcugcuaaccucugguuugc

SEQ ID NO: 533749 - RNA, 32 nt, Human
uuauagaaagcaauccagaugugguuuacucu

SEQ ID NO: 533750 - RNA, 32 nt, Human
uuauagaagggaucaugaaaaggucuggucag

SEQ ID NO: 533751 - RNA, 32 nt, Human
uuauagacugaaauaaaaugaaacuucaaaua

SEQ ID NO: 533752 - RNA, 32 nt, Human
uuauagagaaaagugugaauucagguggagag

SEQ ID NO: 533753 - RNA, 32 nt, Human
uuauagagacaggguuucaccguguuggccag

SEQ ID NO: 533754 - RNA, 32 nt, Human
uuauagagacaggguuucgccauguugcacag

SEQ ID NO: 533755 - RNA, 32 nt, Human
uuauagagacgggguuucaccacguuggccag

SEQ ID NO: 533756 - RNA, 32 nt, Human
uuauagagacgggguuucgccauguuggccag

SEQ ID NO: 533757 - RNA, 32 nt, Human
uuauagagagacucugggccacccucaaacac

SEQ ID NO: 533758 - RNA, 32 nt, Human
uuauagagagaggagaggaggggaagagccuc

SEQ ID NO: 533759 - RNA, 32 nt, Human
uuauagagauaggguuucaccguguuggccag

SEQ ID NO: 533760 - RNA, 32 nt, Human
uuauagagauggggguuuugccauguugccca

SEQ ID NO: 533761 - RNA, 32 nt, Human
uuauagagccuaggcuggaggagguacauggg

SEQ ID NO: 533762 - RNA, 32 nt, Human
uuauagaggcagagucucaccauguugccuag

SEQ ID NO: 533763 - RNA, 32 nt, Human
uuauagaggugggguuuuacuaugcuguccag

SEQ ID NO: 533764 - RNA, 32 nt, Human
uuauagagugaaccaagaugucaguuuuguau

SEQ ID NO: 533765 - RNA, 32 nt, Human
uuauagaucuaauguggaauugcugaacucag

SEQ ID NO: 533766 - RNA, 32 nt, Human
uuauagaugucaggaaacauucagugaaaaac

SEQ ID NO: 533767 - RNA, 32 nt, Human
uuauagcaauuuaagggccaccagaagcaggc

SEQ ID NO: 533768 - RNA, 32 nt, Human
uuauagcacaggcccagguggaucaucucaug

SEQ ID NO: 533769 - RNA, 32 nt, Human
uuauagcacaguuacaguaguucaauggagaa

SEQ ID NO: 533770 - RNA, 32 nt, Human
uuauagcacauacuauuucgcuuuguacuaua

SEQ ID NO: 533771 - RNA, 32 nt, Human
uuauagcagcuaagggcaccugccaggcugga

SEQ ID NO: 533772 - RNA, 32 nt, Human
uuauagcaguacuauaaacccaggaaguuugc

SEQ ID NO: 533773 - RNA, 32 nt, Human
uuauagccaagaagggaaggagacacggggau

SEQ ID NO: 533774 - RNA, 32 nt, Human
uuauagccacguuggcaccucuugaaccucug

SEQ ID NO: 533775 - RNA, 32 nt, Human
uuauagccaggagcaggaggaggacaucacag

SEQ ID NO: 533776 - RNA, 32 nt, Human
uuauagccaguuguaauauacaugcauuccua

SEQ ID NO: 533777 - RNA, 32 nt, Human
uuauagccucaaacucccaggcucaagcaauc

SEQ ID NO: 533778 - RNA, 32 nt, Human
uuauagcucacugcaaaucuaacuucaucaug

SEQ ID NO: 533779 - RNA, 32 nt, Human
uuauagcucacugcagccuggaacuccuggga

SEQ ID NO: 533780 - RNA, 32 nt, Human
uuauagcugugacuucugcccugccaggccgc

SEQ ID NO: 533781 - RNA, 32 nt, Human
uuauagcuuugucaaguaaauuuggacgcagc

SEQ ID NO: 533782 - RNA, 32 nt, Human
uuauaggacaccaagcagauuuaacccaaaga

SEQ ID NO: 533783 - RNA, 32 nt, Human
uuauaggacacggaacucccuggguaggaguu

SEQ ID NO: 533784 - RNA, 24 nt, Human
uuauaggcacaagucaccaugccc

SEQ ID NO: 533785 - RNA, 32 nt, Human
uuauaggcacacaccaccacauccagcuuauu

SEQ ID NO: 533786 - RNA, 32 nt, Human
uuauaggcacacaccaccauacccagcuaauu

SEQ ID NO: 533787 - RNA, 31 nt, Human
uuauaggcacgagccaccaugccaagccugu

SEQ ID NO: 533788 - RNA, 32 nt, Human
uuauaggcaugugccacggugccugacuugag

SEQ ID NO: 533789 - RNA, 32 nt, Human
uuauaggcauguuguuuugaauguggacuuug

SEQ ID NO: 533790 - RNA, 32 nt, Human
uuauaggcgagugccaucaugcccggcuaauu

SEQ ID NO: 533791 - RNA, 32 nt, Human
uuauaggcgugugccauggugccuggcccuua

SEQ ID NO: 533792 - RNA, 32 nt, Human
uuauaggcuauucaguaucaagauagauuucu

SEQ ID NO: 533793 - RNA, 32 nt, Human
uuauaggcuggguguggugagccaccccagcc

SEQ ID NO: 533794 - RNA, 32 nt, Human
uuauagggcaagaccuuugugcuuuugaucau

SEQ ID NO: 533795 - RNA, 32 nt, Human
uuauaggugccacagggcacagcuccaucauu

SEQ ID NO: 533796 - RNA, 32 nt, Human
uuauagucacauagauaauggugccacguguu

SEQ ID NO: 533797 - RNA, 32 nt, Human
uuauagucacauuuacaaccaucuugagauuu

SEQ ID NO: 533798 - RNA, 32 nt, Human
uuauagugauuauucagaagcauuuuaauuua

SEQ ID NO: 533799 - RNA, 32 nt, Human
uuauaguggaagggccuucaauuguaucagua

SEQ ID NO: 533800 - RNA, 32 nt, Human
uuauaguggcugaaaacuggggagauacuuga

SEQ ID NO: 533801 - RNA, 32 nt, Human
uuauagugucugccaugccauguggaaauacu

SEQ ID NO: 533802 - RNA, 32 nt, Human
uuauagugucuuucacguguuugaggccaucu

SEQ ID NO: 533803 - RNA, 32 nt, Human
uuauagugugagccaccgcgucuggcugaaaa

SEQ ID NO: 533804 - RNA, 32 nt, Human
uuauaguuagcccaaagacucugggugugagg

SEQ ID NO: 533805 - RNA, 32 nt, Human
uuauaguuauucuucugaacuaagacauguca

SEQ ID NO: 533806 - RNA, 32 nt, Human
uuauaguucauucauuucucuucaccauguau

SEQ ID NO: 533807 - RNA, 32 nt, Human
uuauaguuuccagaaacguugugcucauuuac

SEQ ID NO: 533808 - RNA, 32 nt, Human
uuauauaaaugcccaaauuugagaugcauuau

SEQ ID NO: 533809 - RNA, 32 nt, Human
uuauauaagaugaaauuaaccauuuuaaagua

SEQ ID NO: 533810 - RNA, 32 nt, Human
uuauauaagcuguaguccacuuuuccaucgua

SEQ ID NO: 533811 - RNA, 32 nt, Human
uuauauaauauauggaggcuguuucucagugu

SEQ ID NO: 533812 - RNA, 32 nt, Human
uuauauaaucuacagauaauuucuacugaaga

SEQ ID NO: 533813 - RNA, 32 nt, Human
uuauauacaagaaaaaccuuuccacugaaaaa

SEQ ID NO: 533814 - RNA, 32 nt, Human
uuauauacacuguuuccuggccccagagcuca

SEQ ID NO: 533815 - RNA, 32 nt, Human
uuauauacagguugaguaucccuucuccaaaa

SEQ ID NO: 533816 - RNA, 32 nt, Human
uuauauacuauggaccuaucagcuccacuuca

SEQ ID NO: 533817 - RNA, 32 nt, Human
uuauauacuguaaggccuucuuuaggccuuua

SEQ ID NO: 533818 - RNA, 32 nt, Human
uuauauaggauggaacaggaagguauguccug

SEQ ID NO: 533819 - RNA, 32 nt, Human
uuauauaguccagcuaauugacauggcccagc

SEQ ID NO: 533820 - RNA, 32 nt, Human
uuauauagugugguugaacaggaugcaaucuu

SEQ ID NO: 533821 - RNA, 32 nt, Human
uuauaucaaaaacuuuccugaccaagaacaaa

SEQ ID NO: 533822 - RNA, 32 nt, Human
uuauaucaauugaggggaaagugcaguacugu

SEQ ID NO: 533823 - RNA, 32 nt, Human
uuauaucacucccagguuuuugacuugggcaa

SEQ ID NO: 533824 - RNA, 32 nt, Human
uuauaucacucuuucuuucaugacauugguua

SEQ ID NO: 533825 - RNA, 32 nt, Human
uuauaucacuggagaacucuuaaaccgacacc

SEQ ID NO: 533826 - RNA, 32 nt, Human
uuauaucagugucuccuccacccucagccucc

SEQ ID NO: 533827 - RNA, 32 nt, Human
uuauaucauccagaaaagaaaaacacgagaaa

SEQ ID NO: 533828 - RNA, 32 nt, Human
uuauaucauuccaccagcaccaccaagaccug

SEQ ID NO: 533829 - RNA, 32 nt, Human
uuauauccaugucuucugaauguggauuccag

SEQ ID NO: 533830 - RNA, 32 nt, Human
uuauauccauugccacagcaauacuguguaac

SEQ ID NO: 533831 - RNA, 32 nt, Human
uuauaucccacugcccugcugugugacaguuu

SEQ ID NO: 533832 - RNA, 32 nt, Human
uuauaucccucaccucuggccucucaucccuu

SEQ ID NO: 533833 - RNA, 32 nt, Human
uuauauccuauaauacaaagcauauuaaaugg

SEQ ID NO: 533834 - RNA, 32 nt, Human
uuauauccuguguugugaccucaugguuuaag

SEQ ID NO: 533835 - RNA, 32 nt, Human
uuauaucugcacauucauaccucuccaaagac

SEQ ID NO: 533836 - RNA, 32 nt, Human
uuauaucugggagaaugcagagcucuaaucgg

SEQ ID NO: 533837 - RNA, 32 nt, Human
uuauaucugucagaugccuagaacagcaccug

SEQ ID NO: 533838 - RNA, 32 nt, Human
uuauaucuugacuugccuuguacaucuuucaa

SEQ ID NO: 533839 - RNA, 32 nt, Human
uuauaucuuggauauuguauuacccuggguau

SEQ ID NO: 533840 - RNA, 32 nt, Human
uuauaucuuuaaguacugcuacuugaauaacu

SEQ ID NO: 533841 - RNA, 32 nt, Human
uuauaucuuucccacauguauguauauucuaa

SEQ ID NO: 533842 - RNA, 32 nt, Human
uuauaucuuugggaacaucucucacccccugg

SEQ ID NO: 533843 - RNA, 32 nt, Human
uuauaugaaacuagauauuuauugcgcucagg

SEQ ID NO: 533844 - RNA, 32 nt, Human
uuauaugaaccaagggaggagucaggaagaga

SEQ ID NO: 533845 - RNA, 32 nt, Human
uuauaugaauuuauuuuacuauuugaaaaugu

SEQ ID NO: 533846 - RNA, 32 nt, Human
uuauaugaggggcaguggacaguucccuaugc

SEQ ID NO: 533847 - RNA, 32 nt, Human
uuauaugauucauauauuuuaugaaucagaau

SEQ ID NO: 533848 - RNA, 32 nt, Human
uuauaugauuccugccauuugcugcuaaaucu

SEQ ID NO: 533849 - RNA, 32 nt, Human
uuauaugcagagccuuggaaagaugggcaaau

SEQ ID NO: 533850 - RNA, 32 nt, Human
uuauaugccaggaagcaggaucgaagaccaaa

SEQ ID NO: 533851 - RNA, 32 nt, Human
uuauaugcccugaauaagucugaaaagguccu

SEQ ID NO: 533852 - RNA, 32 nt, Human
uuauaugcccugcuugggaaauugcagagacc

SEQ ID NO: 533853 - RNA, 32 nt, Human
uuauaugcucugucugugcuuucuagguuacc

SEQ ID NO: 533854 - RNA, 32 nt, Human
uuauaugcugggguaaagcacaaguacagagg

SEQ ID NO: 533855 - RNA, 32 nt, Human
uuauauggaaaaucacugaugucauaucauuu

SEQ ID NO: 533856 - RNA, 32 nt, Human
uuauauggaaccaacgaagugggagcuaaaac

SEQ ID NO: 533857 - RNA, 32 nt, Human
uuauauggauauauguauguguuugcauugac

SEQ ID NO: 533858 - RNA, 23 nt, Human
uuauauggcaaaauaauaaauac

SEQ ID NO: 533859 - RNA, 29 nt, Human
uuauaugggcauggcacuggagcuguacu

SEQ ID NO: 533860 - RNA, 32 nt, Human
uuauaugguuccaggacccagccuucaaaauu

SEQ ID NO: 533861 - RNA, 32 nt, Human
uuauaugucuccauucuuuuuaaaaucuuaac

SEQ ID NO: 533862 - RNA, 23 nt, Human
uuauauguguauaccauaugugg

SEQ ID NO: 533863 - RNA, 20 nt, Human
uuauauguguucacacaugu

SEQ ID NO: 533864 - RNA, 32 nt, Human
uuauauguucaacauggagccaucccagccau

SEQ ID NO: 533865 - RNA, 32 nt, Human
uuauauguuguggaugcaagauuguuuucaga

SEQ ID NO: 533866 - RNA, 32 nt, Human
uuauauuaaaucugggauuaugacgguaucac

SEQ ID NO: 533867 - RNA, 32 nt, Human
uuauauuacaauaugccaauauauuccaauau

SEQ ID NO: 533868 - RNA, 32 nt, Human
uuauauuacagauuuucucuucuuuuaggauu

SEQ ID NO: 533869 - RNA, 32 nt, Human
uuauauuagugccucaggaaugugucacuacu

SEQ ID NO: 533870 - RNA, 32 nt, Human
uuauauuaugaccacacacaucucugcuggaa

SEQ ID NO: 533871 - RNA, 32 nt, Human
uuauauuauuacuaauugucuacuucuggagu

SEQ ID NO: 533872 - RNA, 32 nt, Human
uuauauucacccaacaaaagugucucugugga

SEQ ID NO: 533873 - RNA, 32 nt, Human
uuauauucagcccugaguggagaccuaucaga

SEQ ID NO: 533874 - RNA, 32 nt, Human
uuauauucauuucuucuguucuccuucuguua

SEQ ID NO: 533875 - RNA, 32 nt, Human
uuauauucccuuauuuauugauauuuagucca

SEQ ID NO: 533876 - RNA, 32 nt, Human
uuauauuccguauucuuacaagaagguaagcu

SEQ ID NO: 533877 - RNA, 22 nt, Human
uuauauuccugcaguagacagu

SEQ ID NO: 533878 - RNA, 17 nt, Human
uuauauucuuucagaca

SEQ ID NO: 533879 - RNA, 32 nt, Human
uuauauugaaaaucacugcuuccauagauugg

SEQ ID NO: 533880 - RNA, 32 nt, Human
uuauauugaagcucaggcaagugccuugcaca

SEQ ID NO: 533881 - RNA, 32 nt, Human
uuauauugccuaggcuggaaugcagugguuau

SEQ ID NO: 533882 - RNA, 32 nt, Human
uuauauugcuucugugcuaugguaccagcaga

SEQ ID NO: 533883 - RNA, 31 nt, Human
uuauauuggacaauauagucaaaaccaucuu

SEQ ID NO: 533884 - RNA, 32 nt, Human
uuauauuggccaaaguuuucuuuuccuccacc

SEQ ID NO: 533885 - RNA, 32 nt, Human
uuauauugugaacugccuucucuucaucccaa

SEQ ID NO: 533886 - RNA, 32 nt, Human
uuauauuuacauuuuaauuaaacaguaucaaa

SEQ ID NO: 533887 - RNA, 32 nt, Human
uuauauuuaucuguaccuucuuugcuacuuaa

SEQ ID NO: 533888 - RNA, 32 nt, Human
uuauauuuauguuaauuaugcauaugugugau

SEQ ID NO: 533889 - RNA, 32 nt, Human
uuauauuugcagccacugucagaugggcauca

SEQ ID NO: 533890 - RNA, 32 nt, Human
uuauauuuugacaauaggaaacagugaccauu

SEQ ID NO: 533891 - RNA, 32 nt, Human
uuauauuuugugccucauuuuuggaaagccug

SEQ ID NO: 533892 - RNA, 32 nt, Human
uuauauuuuucagcccuucauccagcaaauca

SEQ ID NO: 533893 - RNA, 32 nt, Human
uuauauuuuugucaugguaaagagguauacuu

SEQ ID NO: 533894 - RNA, 32 nt, Human
uuaucaaaaaggcaggaaaguagguaugaucu

SEQ ID NO: 533895 - RNA, 32 nt, Human
uuaucaaaaauggauuaucuuuagaaaccucu

SEQ ID NO: 533896 - RNA, 32 nt, Human
uuaucaaaacaacaguaauaacaaaacccaga

SEQ ID NO: 533897 - RNA, 32 nt, Human
uuaucaaauacuuuaauagaaccaaaguugca

SEQ ID NO: 533898 - RNA, 32 nt, Human
uuaucaaauguuccuucagcccugcaguugcc

SEQ ID NO: 533899 - RNA, 32 nt, Human
uuaucaaccacagaagucugauauuguaguau

SEQ ID NO: 533900 - RNA, 21 nt, Human
uuaucaacuauugcuagugaa

SEQ ID NO: 533901 - RNA, 32 nt, Human
uuaucaagauugaagucaguacaguauugaca

SEQ ID NO: 533902 - RNA, 32 nt, Human
uuaucaagcuggucaagguagaaauacugaua

SEQ ID NO: 533903 - RNA, 32 nt, Human
uuaucaaggucagagaagaggaaaagagacuc

SEQ ID NO: 533904 - RNA, 32 nt, Human
uuaucaaugucuguuuaauugugugacuaucu

SEQ ID NO: 533905 - RNA, 26 nt, Human
uuaucacaaaaauaaacucauaugaa

SEQ ID NO: 533906 - RNA, 32 nt, Human
uuaucacaacugcacauuucucuaaggucacc

SEQ ID NO: 533907 - RNA, 32 nt, Human
uuaucacaccacugcacuccagccugggugac

SEQ ID NO: 533908 - RNA, 32 nt, Human
uuaucacaccacugcacuucagccuggaugac

SEQ ID NO: 533909 - RNA, 32 nt, Human
uuaucacacugcaucuguuggaauucugcaca

SEQ ID NO: 533910 - RNA, 32 nt, Human
uuaucacagcagaaucaggaucucuuucucau

SEQ ID NO: 533911 - RNA, 32 nt, Human
uuaucaccaaaaagugcuucaucaggcgugcu

SEQ ID NO: 533912 - RNA, 32 nt, Human
uuaucaccaacuuuucuuuaaaaguguuccuu

SEQ ID NO: 533913 - RNA, 32 nt, Human
uuaucaccaagaagcggggcgaucacuuuguc

SEQ ID NO: 533914 - RNA, 32 nt, Human
uuaucaccaugacugcugucagccuggaucga

SEQ ID NO: 533915 - RNA, 32 nt, Human
uuaucaccauuuugguagaugagguugucugg

SEQ ID NO: 533916 - RNA, 32 nt, Human
uuaucacccaggccugauucacuggccuggcg

SEQ ID NO: 533917 - RNA, 32 nt, Human
uuaucaccuuccaaacaaaagcacuuacuuuu

SEQ ID NO: 533918 - RNA, 32 nt, Human
uuaucacgccgcugcacuccagcuugaaugac

SEQ ID NO: 533919 - RNA, 32 nt, Human
uuaucacgcgauggcauccacuguggaaggag

SEQ ID NO: 533920 - RNA, 32 nt, Human
uuaucacuaaaauguuaucuucaagagauguu

SEQ ID NO: 533921 - RNA, 32 nt, Human
uuaucacuacagccaguaaccucuccugugcc

SEQ ID NO: 533922 - RNA, 32 nt, Human
uuaucacuccacccugccucuacuccuccgcc

SEQ ID NO: 533923 - RNA, 32 nt, Human
uuaucacugggcagacgaggaggugguacagc

SEQ ID NO: 533924 - RNA, 32 nt, Human
uuaucacuuuucugcugaaauguacauguuug

SEQ ID NO: 533925 - RNA, 32 nt, Human
uuaucagaaauccugcauaaaaagucagccau

SEQ ID NO: 533926 - RNA, 32 nt, Human
uuaucagaaggaaaaagagcagaauuuucuuc

SEQ ID NO: 533927 - RNA, 32 nt, Human
uuaucagacaccaauaaauucuuuuuguuggg

SEQ ID NO: 533928 - RNA, 32 nt, Human
uuaucagagccaagacaccugcugcagcucuc

SEQ ID NO: 533929 - RNA, 32 nt, Human
uuaucagagccuuagacccagcacuccuugga

SEQ ID NO: 533930 - RNA, 32 nt, Human
uuaucagaguccauauggaguuacugcugugg

SEQ ID NO: 533931 - RNA, 32 nt, Human
uuaucagcaaacacauugucuaaucuuucaaa

SEQ ID NO: 533932 - RNA, 32 nt, Human
uuaucagcaccugaggcaggagaagagaugag

SEQ ID NO: 533933 - RNA, 32 nt, Human
uuaucagcccucucuuuucuuauauuaaacag

SEQ ID NO: 533934 - RNA, 32 nt, Human
uuaucagcgaugccccucugucacucaugccu

SEQ ID NO: 533935 - RNA, 32 nt, Human
uuaucagcuucugcaaggagcuuugucccacc

SEQ ID NO: 533936 - RNA, 32 nt, Human
uuaucaggagugaacccagaggcacguaugaa

SEQ ID NO: 533937 - RNA, 32 nt, Human
uuaucaggcuguguguuaauucugggccaguc

SEQ ID NO: 533938 - RNA, 32 nt, Human
uuaucagggcugggauacuucugauucuggcu

SEQ ID NO: 533939 - RNA, 32 nt, Human
uuaucagggugcuuuggguuuugauuuuguug

SEQ ID NO: 533940 - RNA, 32 nt, Human
uuaucaguauuccaagccugggaugaugcuag

SEQ ID NO: 533941 - RNA, 32 nt, Human
uuaucagucugacaaucucugccuuuugauug

SEQ ID NO: 533942 - RNA, 32 nt, Human
uuaucaguguaagcccugcuuagcucaucuua

SEQ ID NO: 533943 - RNA, 32 nt, Human
uuaucauaaagaaaaagagguuguugcuguag

SEQ ID NO: 533944 - RNA, 22 nt, Human
uuaucauaaauuauuucaugaa

SEQ ID NO: 533945 - RNA, 26 nt, Human
uuaucauaauagcacuguuacaugaa

SEQ ID NO: 533946 - RNA, 32 nt, Human
uuaucauauucauucacacauauuauauguga

SEQ ID NO: 533947 - RNA, 32 nt, Human
uuaucauauugguuuuucauuacuucugaaua

SEQ ID NO: 533948 - RNA, 32 nt, Human
uuaucaucacacaacucagccuggcugauuau

SEQ ID NO: 533949 - RNA, 21 nt, Human
uuaucaucaucaucgucauca

SEQ ID NO: 533950 - RNA, 32 nt, Human
uuaucauccucccuggaaauuuccucaucauu

SEQ ID NO: 533951 - RNA, 32 nt, Human
uuaucaucugagugauauguuucuugaccugu

SEQ ID NO: 533952 - RNA, 32 nt, Human
uuaucaucuguagcuucauccuauccggaggc

SEQ ID NO: 533953 - RNA, 32 nt, Human
uuaucaugaaguuugccuguucuagaauugua

SEQ ID NO: 533954 - RNA, 32 nt, Human
uuaucaugcauguuaugcuuuacugcgaauaa

SEQ ID NO: 533955 - RNA, 31 nt, Human
uuaucauggacaauuugggcuagaggcagga

SEQ ID NO: 533956 - RNA, 32 nt, Human
uuaucauggaggggguacaggaagagacugac

SEQ ID NO: 533957 - RNA, 32 nt, Human
uuaucaugggaaagccuuugcccagaaauaaa

SEQ ID NO: 533958 - RNA, 32 nt, Human
uuaucauucaguuuguucugugcaccugaggc

SEQ ID NO: 533959 - RNA, 32 nt, Human
uuaucauuuggacacaugcacacauacagucu

SEQ ID NO: 533960 - RNA, 32 nt, Human
uuauccaaaagacuugaaacugggguccugag

SEQ ID NO: 533961 - RNA, 32 nt, Human
uuauccaaagccccaaaucccuagagugcuuu

SEQ ID NO: 533962 - RNA, 32 nt, Human
uuauccaacauacaaacuuucccaugcagcuu

SEQ ID NO: 533963 - RNA, 32 nt, Human
uuauccaacauuuuucuuuuucuguguauuac

SEQ ID NO: 533964 - RNA, 32 nt, Human
uuauccaaggagguggcugugcagguggccac

SEQ ID NO: 533965 - RNA, 32 nt, Human
uuauccacaaaugacagcuccuuacuugagca

SEQ ID NO: 533966 - RNA, 32 nt, Human
uuauccacaaauucugucggcuucaucguuaa

SEQ ID NO: 533967 - RNA, 32 nt, Human
uuauccacacacuaaucaucucagugucuuua

SEQ ID NO: 533968 - RNA, 32 nt, Human
uuauccacauccaaaaauuaggaaaagcagga

SEQ ID NO: 533969 - RNA, 32 nt, Human
uuauccaccacagugacaaaggaaaaguggug

SEQ ID NO: 533970 - RNA, 32 nt, Human
uuauccacccaggagcuagggaagagacccua

SEQ ID NO: 533971 - RNA, 32 nt, Human
uuauccacuuaucaguugauggacacuuaggu

SEQ ID NO: 533972 - RNA, 32 nt, Human
uuauccagaaccuucccacggaaggaagcucu

SEQ ID NO: 533973 - RNA, 32 nt, Human
uuauccagagucagaugaggcugcaguccagg

SEQ ID NO: 533974 - RNA, 32 nt, Human
uuauccagaugugacagagcucgacccaagcc

SEQ ID NO: 533975 - RNA, 32 nt, Human
uuauccagccaagaagaugaaaacuacagaga

SEQ ID NO: 533976 - RNA, 32 nt, Human
uuauccagccuaucguugauggauauuugguu

SEQ ID NO: 533977 - RNA, 32 nt, Human
uuauccaggcuggagugcagaggcacagucag

SEQ ID NO: 533978 - RNA, 32 nt, Human
uuauccaggcuggggugcaauggugcgauauc

SEQ ID NO: 533979 - RNA, 32 nt, Human
uuauccaguagagagaaagugacagugaaagu

SEQ ID NO: 533980 - RNA, 32 nt, Human
uuauccauuugcaaauguuuuaaauugcaaag

SEQ ID NO: 533981 - RNA, 32 nt, Human
uuaucccaacaucuagcugcucaggcccuaau

SEQ ID NO: 533982 - RNA, 32 nt, Human
uuaucccaagacuagugugcuuucugcuacac

SEQ ID NO: 533983 - RNA, 32 nt, Human
uuaucccaauuuuaaagauaaggaaaucaaac

SEQ ID NO: 533984 - RNA, 32 nt, Human
uuaucccacugcacucugcuuaaggguuccug

SEQ ID NO: 533985 - RNA, 32 nt, Human
uuaucccagaacuuagauuuuaucgacauuau

SEQ ID NO: 533986 - RNA, 32 nt, Human
uuaucccagcacuuggggaggcugaggcgggc

SEQ ID NO: 533987 - RNA, 32 nt, Human
uuaucccagcacuuugggaggccgaggcaggc

SEQ ID NO: 533988 - RNA, 32 nt, Human
uuaucccagcacuuugggaggccgaggugggc

SEQ ID NO: 533989 - RNA, 32 nt, Human
uuaucccagcacuuugggaggcugaggcgggc

SEQ ID NO: 533990 - RNA, 32 nt, Human
uuaucccagugcuuuaggaggcugaggcaaga

SEQ ID NO: 533991 - RNA, 32 nt, Human
uuauccccacacuugacugggcuguggaggug

SEQ ID NO: 533992 - RNA, 32 nt, Human
uuauccccaccuuggcuaucaucacccgauga

SEQ ID NO: 533993 - RNA, 32 nt, Human
uuauccccagaagaaauacaaaugcagaucaa

SEQ ID NO: 533994 - RNA, 32 nt, Human
uuauccccuuuggaugauggcagaaacuucau

SEQ ID NO: 533995 - RNA, 32 nt, Human
uuaucccgagaggcagcucugcauccuguggu

SEQ ID NO: 533996 - RNA, 32 nt, Human
uuaucccgcucuuggaguuucuagucacucac

SEQ ID NO: 533997 - RNA, 32 nt, Human
uuaucccgggaauucaagguugcagugagcua

SEQ ID NO: 533998 - RNA, 32 nt, Human
uuaucccuaagucacauuggaagugaacuugg

SEQ ID NO: 533999 - RNA, 32 nt, Human
uuaucccucaaauuuuaagugauaugaaauac

SEQ ID NO: 534000 - RNA, 32 nt, Human
uuaucccuguaauuccagggcuuuugggaguu

SEQ ID NO: 534001 - RNA, 32 nt, Human
uuauccgagaugaccagcucugagccaacuuc

SEQ ID NO: 534002 - RNA, 32 nt, Human
uuauccgcgaugcguuuccuggcagcuacauu

SEQ ID NO: 534003 - RNA, 32 nt, Human
uuauccguaagaggcaaggaggaaaccuucuu

SEQ ID NO: 534004 - RNA, 32 nt, Human
uuauccuagacccugaggauauagcuuuuuaa

SEQ ID NO: 534005 - RNA, 32 nt, Human
uuauccuagcuacucaggaggcugaggcagga

SEQ ID NO: 534006 - RNA, 32 nt, Human
uuauccucaagccaauuuccagaaccugccac

SEQ ID NO: 534007 - RNA, 32 nt, Human
uuauccucaagcuccagggcagccuggccgag

SEQ ID NO: 534008 - RNA, 18 nt, Human
uuauccucagucagccag

SEQ ID NO: 534009 - RNA, 32 nt, Human
uuauccucccaaguagcugggauuacagaugc

SEQ ID NO: 534010 - RNA, 32 nt, Human
uuauccucccacccuaccccagaagaggagcu

SEQ ID NO: 534011 - RNA, 32 nt, Human
uuauccucccuucacacgcccccuucccaccg

SEQ ID NO: 534012 - RNA, 32 nt, Human
uuauccuccugacucuucaggccagguagcag

SEQ ID NO: 534013 - RNA, 32 nt, Human
uuauccucuccucugaauuuuguucuucagag

SEQ ID NO: 534014 - RNA, 32 nt, Human
uuauccucuucccagccucaucccuguuuuuc

SEQ ID NO: 534015 - RNA, 32 nt, Human
uuauccucuuccuccucuuccuccuccuggug

SEQ ID NO: 534016 - RNA, 32 nt, Human
uuauccugaagucaucaaugauuucccuuuga

SEQ ID NO: 534017 - RNA, 32 nt, Human
uuauccugaauuccccuugccaccccacccuc

SEQ ID NO: 534018 - RNA, 32 nt, Human
uuauccugaguacugggauuacaggcgcccac

SEQ ID NO: 534019 - RNA, 32 nt, Human
uuauccugcuuugguuuuagagugauugugag

SEQ ID NO: 534020 - RNA, 32 nt, Human
uuauccuggaguuuacaaauccaaauauugac

SEQ ID NO: 534021 - RNA, 32 nt, Human
uuauccugggagauggggaggaagccccaucu

SEQ ID NO: 534022 - RNA, 32 nt, Human
uuauccugggcugugcggggccgaggcugcuu

SEQ ID NO: 534023 - RNA, 32 nt, Human
uuauccuggugccugauugggguggggacugu

SEQ ID NO: 534024 - RNA, 32 nt, Human
uuauccuucauaauccucagcuuuccccuucc

SEQ ID NO: 534025 - RNA, 32 nt, Human
uuauccuugcuucucuguggccugugccaugg

SEQ ID NO: 534026 - RNA, 32 nt, Human
uuauccuuucugcuuuccuccuggaagcauua

SEQ ID NO: 534027 - RNA, 32 nt, Human
uuaucgcauagaguucagagacuggaaacuga

SEQ ID NO: 534028 - RNA, 24 nt, Human
uuaucgcccaggcuggaguacagu

SEQ ID NO: 534029 - RNA, 32 nt, Human
uuaucgcccaggcuggaguacagugaugcaau

SEQ ID NO: 534030 - RNA, 32 nt, Human
uuaucgcccaggcuggggugcaauggcgcaac

SEQ ID NO: 534031 - RNA, 32 nt, Human
uuaucggaggcugcgggacuguucuguugugg

SEQ ID NO: 534032 - RNA, 32 nt, Human
uuaucggugcccauuauauccuuaaguuugga

SEQ ID NO: 534033 - RNA, 32 nt, Human
uuaucgucauaaaaacaguuggugacagcaac

SEQ ID NO: 534034 - RNA, 32 nt, Human
uuaucguugcuacugauuagguccauggaggg

SEQ ID NO: 534035 - RNA, 23 nt, Human
uuaucuaaagcauugucagugaa

SEQ ID NO: 534036 - RNA, 32 nt, Human
uuaucuaacccucuuuuccuacaaaggagaaa

SEQ ID NO: 534037 - RNA, 32 nt, Human
uuaucuacccauuaacacuuguuagagacacc

SEQ ID NO: 534038 - RNA, 32 nt, Human
uuaucuacccuuuggcacuuaucuugcuuauc

SEQ ID NO: 534039 - RNA, 32 nt, Human
uuaucuacuagauuauuuccucuaauaaaauc

SEQ ID NO: 534040 - RNA, 32 nt, Human
uuaucuauaucaucuuacugccugugugugug

SEQ ID NO: 534041 - RNA, 32 nt, Human
uuaucuaugcuauuuaggacuacuuucuggag

SEQ ID NO: 534042 - RNA, 32 nt, Human
uuaucucacacccugaggaauaaagauuggaa

SEQ ID NO: 534043 - RNA, 32 nt, Human
uuaucucagaagacuauuucuaggauuaacug

SEQ ID NO: 534044 - RNA, 32 nt, Human
uuaucuccaagcucagggcaaucccuucccuc

SEQ ID NO: 534045 - RNA, 32 nt, Human
uuaucuccaucuuuaugucucuguguacccau

SEQ ID NO: 534046 - RNA, 32 nt, Human
uuaucuccccuucacaugauuccuucugugcc

SEQ ID NO: 534047 - RNA, 32 nt, Human
uuaucucccuuccccuuccuaagucccauuuc

SEQ ID NO: 534048 - RNA, 32 nt, Human
uuaucucccuugcuccccuuuaaacaccugcg

SEQ ID NO: 534049 - RNA, 32 nt, Human
uuaucucccuuuccacucucuuuccaauuuca

SEQ ID NO: 534050 - RNA, 32 nt, Human
uuaucuccuaguuucuucaaugcuuacgccuu

SEQ ID NO: 534051 - RNA, 32 nt, Human
uuaucuccucccagccuugagggagggaacaa

SEQ ID NO: 534052 - RNA, 32 nt, Human
uuaucucgaccagccaagcucuggagagcaau

SEQ ID NO: 534053 - RNA, 32 nt, Human
uuaucucucgaguuuugaagcugaacaguagc

SEQ ID NO: 534054 - RNA, 32 nt, Human
uuaucucugccuccuuccuccuccuucccagu

SEQ ID NO: 534055 - RNA, 32 nt, Human
uuaucucugugucccucuaccuaauucucuua

SEQ ID NO: 534056 - RNA, 32 nt, Human
uuaucucuuuucagaggggaaaaaggagcagc

SEQ ID NO: 534057 - RNA, 32 nt, Human
uuaucugaaacucuugcacuuccccaaccagg

SEQ ID NO: 534058 - RNA, 32 nt, Human
uuaucugagaggauggaaguggugagggcauc

SEQ ID NO: 534059 - RNA, 32 nt, Human
uuaucugauuuaauacauauuauugaauauca

SEQ ID NO: 534060 - RNA, 32 nt, Human
uuaucugcaggaguucaagaccagccugggga

SEQ ID NO: 534061 - RNA, 32 nt, Human
uuaucugccugaggaagaugcauucugggcac

SEQ ID NO: 534062 - RNA, 32 nt, Human
uuaucugcgacucuccagcccagcgagaggcg

SEQ ID NO: 534063 - RNA, 32 nt, Human
uuaucugcucucacacugcucauaaagacaua

SEQ ID NO: 534064 - RNA, 32 nt, Human
uuaucugcuuugacaaagccuuucugaaacgc

SEQ ID NO: 534065 - RNA, 32 nt, Human
uuaucuggaaguaaccauuugcacuggaguuc

SEQ ID NO: 534066 - RNA, 32 nt, Human
uuaucuggcaaaauuuugcuuuccagaaauac

SEQ ID NO: 534067 - RNA, 32 nt, Human
uuaucuggccaucagccagggacagagcugca

SEQ ID NO: 534068 - RNA, 32 nt, Human
uuaucuggcuuaucgucucucccucagcaaag

SEQ ID NO: 534069 - RNA, 32 nt, Human
uuaucuggcuuaucgucucucccucagcgaag

SEQ ID NO: 534070 - RNA, 32 nt, Human
uuaucugggggucuuguccacccuggcuggau

SEQ ID NO: 534071 - RNA, 32 nt, Human
uuaucuggguaucaagcaaaucugaccacauc

SEQ ID NO: 534072 - RNA, 32 nt, Human
uuaucuguaaacacagggaggcagguauggau

SEQ ID NO: 534073 - RNA, 32 nt, Human
uuaucuguaauauuucaguccuuuacaagcca

SEQ ID NO: 534074 - RNA, 32 nt, Human
uuaucugugaagcucaggaaauccaaacauuu

SEQ ID NO: 534075 - RNA, 32 nt, Human
uuaucugugaggaauggacucuccccagacgc

SEQ ID NO: 534076 - RNA, 32 nt, Human
uuaucuguugcaacugaaaacaaaaucuggaa

SEQ ID NO: 534077 - RNA, 32 nt, Human
uuaucuuagaagcacuacaccuugccuugcug

SEQ ID NO: 534078 - RNA, 32 nt, Human
uuaucuuagcacuuugggaggcugaggaugga

SEQ ID NO: 534079 - RNA, 32 nt, Human
uuaucuuauaagaggaaaacaugacaaucauu

SEQ ID NO: 534080 - RNA, 32 nt, Human
uuaucuucaacuugaagcuuuccaauggcgcu

SEQ ID NO: 534081 - RNA, 32 nt, Human
uuaucuuccaccaccuuccuugcuugcagggu

SEQ ID NO: 534082 - RNA, 32 nt, Human
uuaucuucccaagagccccaugaggcgaugac

SEQ ID NO: 534083 - RNA, 32 nt, Human
uuaucuuccccuuggaaagacuaaugagcaca

SEQ ID NO: 534084 - RNA, 32 nt, Human
uuaucuuccggccccguaccacugugccacag

SEQ ID NO: 534085 - RNA, 32 nt, Human
uuaucuuccuuucuaagacauauuuaauguag

SEQ ID NO: 534086 - RNA, 32 nt, Human
uuaucuucuuuaacaaacuuuacucuuauucu

SEQ ID NO: 534087 - RNA, 32 nt, Human
uuaucuugaaggaaccauuagauauggaaaau

SEQ ID NO: 534088 - RNA, 32 nt, Human
uuaucuugcccuuuucauucuaccaacagauc

SEQ ID NO: 534089 - RNA, 32 nt, Human
uuaucuugcuucuucccccaguuucagggauc

SEQ ID NO: 534090 - RNA, 32 nt, Human
uuaucuuuaauaaaauguuauuaugucaacca

SEQ ID NO: 534091 - RNA, 32 nt, Human
uuaucuuuaguguucaguagcagcggggauag

SEQ ID NO: 534092 - RNA, 32 nt, Human
uuaucuuucucccacuccacuuuuccuucaag

SEQ ID NO: 534093 - RNA, 32 nt, Human
uuaucuuucugaccaaaggagcaagagguaua

SEQ ID NO: 534094 - RNA, 32 nt, Human
uuaucuuucuucuguuucuuccuccccgcugu

SEQ ID NO: 534095 - RNA, 32 nt, Human
uuaucuuugacucucuugccuguuaugcuuac

SEQ ID NO: 534096 - RNA, 32 nt, Human
uuaucuuuucucuuggacuuaacaaacauacu

SEQ ID NO: 534097 - RNA, 32 nt, Human
uuaugaaaaaggccucaaggaguacguguuca

SEQ ID NO: 534098 - RNA, 32 nt, Human
uuaugaaaacauuuuauaauuuuaaauggauc

SEQ ID NO: 534099 - RNA, 32 nt, Human
uuaugaaaaggaggaggaacaggaccaagggg

SEQ ID NO: 534100 - RNA, 32 nt, Human
uuaugaaaccaaaaacaaacaaguuugcuuuc

SEQ ID NO: 534101 - RNA, 32 nt, Human
uuaugaaacugucuugaguucuucuugaauug

SEQ ID NO: 534102 - RNA, 32 nt, Human
uuaugaaaguagaagcaagaaucaguugguuu

SEQ ID NO: 534103 - RNA, 32 nt, Human
uuaugaaccagucagcuaucugucuuuugaaa

SEQ ID NO: 534104 - RNA, 32 nt, Human
uuaugaaccucaccuucucugauugugggagu

SEQ ID NO: 534105 - RNA, 32 nt, Human
uuaugaacuguacuggcuguugaccaccagac

SEQ ID NO: 534106 - RNA, 32 nt, Human
uuaugaagaggaccucugacuugcuugagagu

SEQ ID NO: 534107 - RNA, 32 nt, Human
uuaugaaggaagcuaagcacggcugcucacug

SEQ ID NO: 534108 - RNA, 32 nt, Human
uuaugaaggcaucauugauuaagccauuggcc

SEQ ID NO: 534109 - RNA, 32 nt, Human
uuaugaaguaggcuuuucauggggagagauug

SEQ ID NO: 534110 - RNA, 18 nt, Human
uuaugaauaaauaugcag

SEQ ID NO: 534111 - RNA, 32 nt, Human
uuaugaauacaaaucagugggccuucucuaug

SEQ ID NO: 534112 - RNA, 32 nt, Human
uuaugaauggguggaaaggugugagacuggga

SEQ ID NO: 534113 - RNA, 32 nt, Human
uuaugaauguagagaaauucaccagagcucac

SEQ ID NO: 534114 - RNA, 32 nt, Human
uuaugaauugacgacaggugcagagagagaau

SEQ ID NO: 534115 - RNA, 32 nt, Human
uuaugaauugccucugcacaccuagaguccca

SEQ ID NO: 534116 - RNA, 32 nt, Human
uuaugacacuuucucagaucaggauuuucuag

SEQ ID NO: 534117 - RNA, 32 nt, Human
uuaugacaguuuguaugugcucagccaaugag

SEQ ID NO: 534118 - RNA, 32 nt, Human
uuaugaccaauacuuguuauaacuuagaggac

SEQ ID NO: 534119 - RNA, 32 nt, Human
uuaugaccauuuuacagaugggagaacagucu

SEQ ID NO: 534120 - RNA, 32 nt, Human
uuaugacccaaaacuuaccccagauccagaaa

SEQ ID NO: 534121 - RNA, 32 nt, Human
uuaugaccucagagacuccugaggcagcaauu

SEQ ID NO: 534122 - RNA, 32 nt, Human
uuaugaccucaggugauccuccugccuuggcc

SEQ ID NO: 534123 - RNA, 32 nt, Human
uuaugacugcaacuugccuuuuccauuacaga

SEQ ID NO: 534124 - RNA, 28 nt, Human
uuaugacuggaaaauauuugccaaugaa

SEQ ID NO: 534125 - RNA, 32 nt, Human
uuaugagaaauguuaugaaggaaaggacaaca

SEQ ID NO: 534126 - RNA, 32 nt, Human
uuaugagaagcagagggaggaccucaagagac

SEQ ID NO: 534127 - RNA, 32 nt, Human
uuaugagaauauuuuccuuugcccucaugagc

SEQ ID NO: 534128 - RNA, 32 nt, Human
uuaugagaauggaguccucaugaccuaaucgu

SEQ ID NO: 534129 - RNA, 32 nt, Human
uuaugagacagguccucaggccuguguuccaa

SEQ ID NO: 534130 - RNA, 32 nt, Human
uuaugagagaaauguugggcaacuguuuuuac

SEQ ID NO: 534131 - RNA, 32 nt, Human
uuaugagagcccguaguuacaguguccucuaa

SEQ ID NO: 534132 - RNA, 32 nt, Human
uuaugagaggcuaggucauccaaagagaagac

SEQ ID NO: 534133 - RNA, 32 nt, Human
uuaugagauguggcuugggcagcauccccuug

SEQ ID NO: 534134 - RNA, 32 nt, Human
uuaugagcaaauuuaccuuucucuccaaguuc

SEQ ID NO: 534135 - RNA, 31 nt, Human
uuaugagcacaaugccaucacuuaacuauaa

SEQ ID NO: 534136 - RNA, 32 nt, Human
uuaugagcauuuuuaucaccuuuccucacaua

SEQ ID NO: 534137 - RNA, 32 nt, Human
uuaugagcuaccaaaacuaaauucuuucucug

SEQ ID NO: 534138 - RNA, 32 nt, Human
uuaugaggaugccaccaucaugacauaaucau

SEQ ID NO: 534139 - RNA, 32 nt, Human
uuaugaggaugccaccaucaugacauacucau

SEQ ID NO: 534140 - RNA, 20 nt, Human
uuaugaggauucaaugagga

SEQ ID NO: 534141 - RNA, 32 nt, Human
uuaugaggauuucuugggagucuuaauaaccu

SEQ ID NO: 534142 - RNA, 32 nt, Human
uuaugagggcuccacagacagaugggggaggc

SEQ ID NO: 534143 - RNA, 32 nt, Human
uuaugagggcuggagugcacuggagcaauccu

SEQ ID NO: 534144 - RNA, 27 nt, Human
uuaugaguaggccuguaacacggacgu

SEQ ID NO: 534145 - RNA, 32 nt, Human
uuaugagucgcugggccagggugaggaccugg

SEQ ID NO: 534146 - RNA, 32 nt, Human
uuaugagugaaaaguguuucuaaaaauauaga

SEQ ID NO: 534147 - RNA, 32 nt, Human
uuaugagugaauauggggagggcggggcaauc

SEQ ID NO: 534148 - RNA, 32 nt, Human
uuaugaguugcuuugggagacuuggagcucuc

SEQ ID NO: 534149 - RNA, 32 nt, Human
uuaugauaaggaugauaaaagcacuuacuucg

SEQ ID NO: 534150 - RNA, 32 nt, Human
uuaugauauauacuuacuuaagcuucuauuua

SEQ ID NO: 534151 - RNA, 32 nt, Human
uuaugaucuguuuccaaaauuggcacaaagug

SEQ ID NO: 534152 - RNA, 32 nt, Human
uuaugaugaccagggccacauccggagggggc

SEQ ID NO: 534153 - RNA, 32 nt, Human
uuaugaugagaccagaugcaguggcucaggcc

SEQ ID NO: 534154 - RNA, 32 nt, Human
uuaugaugcuaaacugacauuauuucuucucu

SEQ ID NO: 534155 - RNA, 32 nt, Human
uuaugauguuggcuuggcuuuguauuuuuaau

SEQ ID NO: 534156 - RNA, 32 nt, Human
uuaugauugcagcccucagccugggcugccug

SEQ ID NO: 534157 - RNA, 31 nt, Human
uuaugauugcguuucugaccugagauguaug

SEQ ID NO: 534158 - RNA, 32 nt, Human
uuaugauugcguuucugaccugagauguaugc

SEQ ID NO: 534159 - RNA, 32 nt, Human
uuaugauuguuuccuuuucucaugcuucuuau

SEQ ID NO: 534160 - RNA, 32 nt, Human
uuaugauuguuuuaaacucaggaacagagaca

SEQ ID NO: 534161 - RNA, 32 nt, Human
uuaugcaauuccuucuguugcauuggagaaac

SEQ ID NO: 534162 - RNA, 32 nt, Human
uuaugcacuuucaugguauagucuuucucagu

SEQ ID NO: 534163 - RNA, 32 nt, Human
uuaugcagaagagacagaggagaggaaaggga

SEQ ID NO: 534164 - RNA, 32 nt, Human
uuaugcagacacacaaguggucuggacaugag

SEQ ID NO: 534165 - RNA, 32 nt, Human
uuaugcagauguucacugggaggaccugccag

SEQ ID NO: 534166 - RNA, 32 nt, Human
uuaugcaggagcagguucauguccuuggaguu

SEQ ID NO: 534167 - RNA, 32 nt, Human
uuaugcagguggagagaaaacaggagaguagc

SEQ ID NO: 534168 - RNA, 32 nt, Human
uuaugcagugccugggacacaguaggcacuca

SEQ ID NO: 534169 - RNA, 32 nt, Human
uuaugcauauaguaaguauuacauucuuagag

SEQ ID NO: 534170 - RNA, 32 nt, Human
uuaugcauauuucaucuggaacuuuccccuuu

SEQ ID NO: 534171 - RNA, 32 nt, Human
uuaugcaucccucagugccaucccuuguaucc

SEQ ID NO: 534172 - RNA, 32 nt, Human
uuaugcauguguggucugucucuacaaucuga

SEQ ID NO: 534173 - RNA, 32 nt, Human
uuaugccaacagcaaagcugucacacuggagg

SEQ ID NO: 534174 - RNA, 32 nt, Human
uuaugccaacauuuucuuuucuguuaagguug

SEQ ID NO: 534175 - RNA, 32 nt, Human
uuaugccaagggaagcgggaccucuuuuguca

SEQ ID NO: 534176 - RNA, 32 nt, Human
uuaugccacugcacuccagccugggcaacaga

SEQ ID NO: 534177 - RNA, 32 nt, Human
uuaugccacugcacuccagccugggugacaga

SEQ ID NO: 534178 - RNA, 32 nt, Human
uuaugccacugcacuccagccuggugacagag

SEQ ID NO: 534179 - RNA, 32 nt, Human
uuaugccacugcacuucagccugggugacaga

SEQ ID NO: 534180 - RNA, 32 nt, Human
uuaugccacugcuuuccagccugggcaacaua

SEQ ID NO: 534181 - RNA, 32 nt, Human
uuaugccacuguacuccagccugggugacaga

SEQ ID NO: 534182 - RNA, 32 nt, Human
uuaugccacuguacuccagcgugggugacaga

SEQ ID NO: 534183 - RNA, 32 nt, Human
uuaugccagagccucagcucuagggcugccug

SEQ ID NO: 534184 - RNA, 32 nt, Human
uuaugccaguuggggagggaaggacuaaaaau

SEQ ID NO: 534185 - RNA, 32 nt, Human
uuaugccaugauaaauacaagauugguaaaua

SEQ ID NO: 534186 - RNA, 32 nt, Human
uuaugccauuacacuccagccugggcaacagc

SEQ ID NO: 534187 - RNA, 32 nt, Human
uuaugccauugcacuccagccugggugacaaa

SEQ ID NO: 534188 - RNA, 32 nt, Human
uuaugccauugcacuccagccugggugacaga

SEQ ID NO: 534189 - RNA, 32 nt, Human
uuaugcccauaauaaucccagcacuuugggag

SEQ ID NO: 534190 - RNA, 32 nt, Human
uuaugccccugcacaucagccugggugauaga

SEQ ID NO: 534191 - RNA, 32 nt, Human
uuaugccggaagcaaaaaccaaaacuuuuugu

SEQ ID NO: 534192 - RNA, 32 nt, Human
uuaugccuaaagccuggugauuauucauuuaa

SEQ ID NO: 534193 - RNA, 19 nt, Human
uuaugccuaaaucucuaua

SEQ ID NO: 534194 - RNA, 32 nt, Human
uuaugccuaagggaccugcucccauuuucuuu

SEQ ID NO: 534195 - RNA, 32 nt, Human
uuaugccuaggagguugaggcugcagugagcu

SEQ ID NO: 534196 - RNA, 32 nt, Human
uuaugccuccaccccuucuuauucauuuacuu

SEQ ID NO: 534197 - RNA, 32 nt, Human
uuaugccucugucucuuucucucccuccuccu

SEQ ID NO: 534198 - RNA, 32 nt, Human
uuaugccugcaauuuuaccuagcuaccacuag

SEQ ID NO: 534199 - RNA, 32 nt, Human
uuaugccuguaaucccacuuugggaggccaag

SEQ ID NO: 534200 - RNA, 32 nt, Human
uuaugccuguaaucccagcacucugggaggcc

SEQ ID NO: 534201 - RNA, 32 nt, Human
uuaugccuguaaucccagcacugugggaggcu

SEQ ID NO: 534202 - RNA, 32 nt, Human
uuaugccuguaaucccagcacuuggggaagcc

SEQ ID NO: 534203 - RNA, 32 nt, Human
uuaugccuguaaucccagcacuuuggaaggcc

SEQ ID NO: 534204 - RNA, 32 nt, Human
uuaugccuguaaucccagcacuuugggaggcc

SEQ ID NO: 534205 - RNA, 32 nt, Human
uuaugccuguaaucccagcacuuugggaggcu

SEQ ID NO: 534206 - RNA, 32 nt, Human
uuaugccuguaaucccagcaugcugggaggcc

SEQ ID NO: 534207 - RNA, 32 nt, Human
uuaugccuguaaucccgguacuuugggaggcu

SEQ ID NO: 534208 - RNA, 32 nt, Human
uuaugccuguaaucccugcacuuugggaagcc

SEQ ID NO: 534209 - RNA, 32 nt, Human
uuaugccuguaauccuagaacuuugggaggcc

SEQ ID NO: 534210 - RNA, 32 nt, Human
uuaugccuguaauccuagcgcuuugggaggcc

SEQ ID NO: 534211 - RNA, 32 nt, Human
uuaugccuguaauugcagcacuuuuagaggcu

SEQ ID NO: 534212 - RNA, 32 nt, Human
uuaugccuuauucauaucacaguuagaucacc

SEQ ID NO: 534213 - RNA, 32 nt, Human
uuaugccuucauucucuuacauuugugugggu

SEQ ID NO: 534214 - RNA, 32 nt, Human
uuaugcgggaaagagggagggggacuccagga

SEQ ID NO: 534215 - RNA, 32 nt, Human
uuaugcguguccacaguacacccucccucucc

SEQ ID NO: 534216 - RNA, 32 nt, Human
uuaugcguuugacugaaaaagacacuguauua

SEQ ID NO: 534217 - RNA, 32 nt, Human
uuaugcuccuuaugagaaucuaaugccugaug

SEQ ID NO: 534218 - RNA, 32 nt, Human
uuaugcugaaauuggcuucugccggcuuaucu

SEQ ID NO: 534219 - RNA, 28 nt, Human
uuaugcugaguugcugccuuuccccguc

SEQ ID NO: 534220 - RNA, 32 nt, Human
uuaugcugccauccuuuuugcaugucaaauaa

SEQ ID NO: 534221 - RNA, 32 nt, Human
uuaugcugccuuucuacucuguucuugcuguc

SEQ ID NO: 534222 - RNA, 32 nt, Human
uuaugcugcuacuugccaggaacagguuggga

SEQ ID NO: 534223 - RNA, 32 nt, Human
uuaugcugcucacugauccuucugcauauuua

SEQ ID NO: 534224 - RNA, 32 nt, Human
uuaugcugcucucccagggccugggugugcuu

SEQ ID NO: 534225 - RNA, 32 nt, Human
uuaugcugcugcacuccagccuggacaacaga

SEQ ID NO: 534226 - RNA, 32 nt, Human
uuaugcuggagcucuguuuugcuuagaaauaa

SEQ ID NO: 534227 - RNA, 32 nt, Human
uuaugcuggauuccguuuaaagaagacauuau

SEQ ID NO: 534228 - RNA, 32 nt, Human
uuaugcugucauaucagagucaagugaacugu

SEQ ID NO: 534229 - RNA, 32 nt, Human
uuaugcuuagcagcuucuucacuguuuugaaa

SEQ ID NO: 534230 - RNA, 32 nt, Human
uuaugcuuauuugccauucacauauuuucuug

SEQ ID NO: 534231 - RNA, 32 nt, Human
uuaugcuucaugggauuaacacugcuuuucca

SEQ ID NO: 534232 - RNA, 32 nt, Human
uuaugcuuccuucuuuccaugacuaauucuuc

SEQ ID NO: 534233 - RNA, 32 nt, Human
uuaugcuucuuucaguauguuuugccauguua

SEQ ID NO: 534234 - RNA, 32 nt, Human
uuaugcuugggaggucgaggcugcagugaguc

SEQ ID NO: 534235 - RNA, 32 nt, Human
uuaugcuugguacaagcuuaugcugucuuaaa

SEQ ID NO: 534236 - RNA, 32 nt, Human
uuaugcuuguaaucccaacacuuagggaguca

SEQ ID NO: 534237 - RNA, 32 nt, Human
uuaugcuuguaaucccagaacuuugggaaucu

SEQ ID NO: 534238 - RNA, 32 nt, Human
uuaugcuuguaaucccagcacuuugggaggcc

SEQ ID NO: 534239 - RNA, 24 nt, Human
uuaugcuugucuccugacugcucu

SEQ ID NO: 534240 - RNA, 32 nt, Human
uuaugcuuuagcugcagguggggacgacaaac

SEQ ID NO: 534241 - RNA, 32 nt, Human
uuaugcuuuguugcaucucugcuuucuaauaa

SEQ ID NO: 534242 - RNA, 32 nt, Human
uuaugcuuuucaggcucauuuguacucucuuc

SEQ ID NO: 534243 - RNA, 32 nt, Human
uuauggaaauuggggaaagugguaaaaugagu

SEQ ID NO: 534244 - RNA, 32 nt, Human
uuauggaaccuacauaugggucuggaaaaacu

SEQ ID NO: 534245 - RNA, 32 nt, Human
uuauggaagccugucuugccuuugacuugcaa

SEQ ID NO: 534246 - RNA, 32 nt, Human
uuauggaagugagaggaagcaaacaagcuucu

SEQ ID NO: 534247 - RNA, 23 nt, Human
uuauggaauguagucgacggaua

SEQ ID NO: 534248 - RNA, 32 nt, Human
uuauggaccaaaacuugaaucacugcaaaaug

SEQ ID NO: 534249 - RNA, 32 nt, Human
uuauggacuauacacaccuauuauuauauucu

SEQ ID NO: 534250 - RNA, 32 nt, Human
uuauggacugagaaagggagaacaugguaggg

SEQ ID NO: 534251 - RNA, 32 nt, Human
uuauggacugaggacuggugacuggucuguga

SEQ ID NO: 534252 - RNA, 32 nt, Human
uuauggagaaccuggggaucacagacuucauc

SEQ ID NO: 534253 - RNA, 32 nt, Human
uuauggagacccauuuccugaucucugagacu

SEQ ID NO: 534254 - RNA, 32 nt, Human
uuauggagauggggucuugcuuuguugcccag

SEQ ID NO: 534255 - RNA, 32 nt, Human
uuauggagcucucagugugugaaaguucuaaa

SEQ ID NO: 534256 - RNA, 32 nt, Human
uuauggaggaggaggagaauguggaagaggua

SEQ ID NO: 534257 - RNA, 32 nt, Human
uuauggaggaggugaugguggauauaauggau

SEQ ID NO: 534258 - RNA, 32 nt, Human
uuauggauccaaggagacuugcuuuuucaguc

SEQ ID NO: 534259 - RNA, 32 nt, Human
uuauggauucuaggugggaagaaacaaaacaa

SEQ ID NO: 534260 - RNA, 32 nt, Human
uuauggauuucacgccccuaucaugcccuggc

SEQ ID NO: 534261 - RNA, 32 nt, Human
uuauggcacauagacaucagcuaggcuuuugg

SEQ ID NO: 534262 - RNA, 32 nt, Human
uuauggcaccuugcagcuucuucuccacgagu

SEQ ID NO: 534263 - RNA, 32 nt, Human
uuauggcagggaacagguggggaacuaagauc

SEQ ID NO: 534264 - RNA, 32 nt, Human
uuauggcauuucccaggguucugugauuuccc

SEQ ID NO: 534265 - RNA, 32 nt, Human
uuauggccacaguguauaacuuuuauuaaaau

SEQ ID NO: 534266 - RNA, 32 nt, Human
uuauggccauuuuccuuaucucccucccaagg

SEQ ID NO: 534267 - RNA, 32 nt, Human
uuauggcccuucuguucucaggauggagagaa

SEQ ID NO: 534268 - RNA, 32 nt, Human
uuauggccucugcacuccagccugggugacag

SEQ ID NO: 534269 - RNA, 32 nt, Human
uuauggcgcuugcauuuugguggaggaagaca

SEQ ID NO: 534270 - RNA, 32 nt, Human
uuauggcucacugcaguuucaaccucccagau

SEQ ID NO: 534271 - RNA, 32 nt, Human
uuauggcucacugcggccucgacuuuccaguc

SEQ ID NO: 534272 - RNA, 32 nt, Human
uuauggcuccaccuccccaccucccucccccg

SEQ ID NO: 534273 - RNA, 32 nt, Human
uuauggcuccucccucccauguccucagaccc

SEQ ID NO: 534274 - RNA, 32 nt, Human
uuauggcuuauaaaacagugcauaaucugacu

SEQ ID NO: 534275 - RNA, 32 nt, Human
uuauggcuucaaggucuacaauuuauguguau

SEQ ID NO: 534276 - RNA, 32 nt, Human
uuauggcuucacugcagguaaugccuuucccu

SEQ ID NO: 534277 - RNA, 32 nt, Human
uuaugggaaaguuuucucugaagccagggaga

SEQ ID NO: 534278 - RNA, 32 nt, Human
uuaugggaaguuuggcagaaugugaguaucuu

SEQ ID NO: 534279 - RNA, 32 nt, Human
uuaugggacaaagccuagaaaagagaaaugua

SEQ ID NO: 534280 - RNA, 32 nt, Human
uuaugggaggcugagagacugagggucuuucu

SEQ ID NO: 534281 - RNA, 32 nt, Human
uuaugggaggcugaggcgggcagaucaugagg

SEQ ID NO: 534282 - RNA, 32 nt, Human
uuaugggcagaggcacaggcauccucagcagc

SEQ ID NO: 534283 - RNA, 32 nt, Human
uuaugggcaugacugcguguucccuuccccca

SEQ ID NO: 534284 - RNA, 32 nt, Human
uuaugggcgcugugggcccugaaggaagaccu

SEQ ID NO: 534285 - RNA, 32 nt, Human
uuaugggcucagaaagggaagaagaauugaau

SEQ ID NO: 534286 - RNA, 32 nt, Human
uuaugggcuuaagaagaagaccaccuugucua

SEQ ID NO: 534287 - RNA, 32 nt, Human
uuaugggcuuuugccacauggaggcuuugugu

SEQ ID NO: 534288 - RNA, 32 nt, Human
uuauggggagagaggcugccaggggccaggcu

SEQ ID NO: 534289 - RNA, 32 nt, Human
uuauggggagugagagagagggcacgagaacc

SEQ ID NO: 534290 - RNA, 32 nt, Human
uuauggggcaggcaaugugugcggagauggga

SEQ ID NO: 534291 - RNA, 32 nt, Human
uuauggggcagguggagggcccggcugacuca

SEQ ID NO: 534292 - RNA, 32 nt, Human
uuauggggucugcuugagggcacuaaccucaa

SEQ ID NO: 534293 - RNA, 32 nt, Human
uuaugggugccugccaccacacccagcuaauu

SEQ ID NO: 534294 - RNA, 32 nt, Human
uuauggguugggggugguaggcaggugagcgu

SEQ ID NO: 534295 - RNA, 32 nt, Human
uuauggguuuggcuuaguugaagaggaaaggg

SEQ ID NO: 534296 - RNA, 32 nt, Human
uuaugguaaagaugggagcccaguuucacugc

SEQ ID NO: 534297 - RNA, 32 nt, Human
uuauggucuucaucccuccaucaaccuuaauc

SEQ ID NO: 534298 - RNA, 32 nt, Human
uuauggugcuucuguuggcauaguuggggaaa

SEQ ID NO: 534299 - RNA, 32 nt, Human
uuaugguuaaugcucaguacaaauuaacgauu

SEQ ID NO: 534300 - RNA, 32 nt, Human
uuaugguucacugcagacuccaccucuccagg

SEQ ID NO: 534301 - RNA, 32 nt, Human
uuaugguuguagugugugugggaaaaccuuua

SEQ ID NO: 534302 - RNA, 32 nt, Human
uuaugguuugcaucugaaagcaguuaaaucuu

SEQ ID NO: 534303 - RNA, 17 nt, Human
uuauguaaaauggggug

SEQ ID NO: 534304 - RNA, 20 nt, Human
uuauguaaaauggugcagua

SEQ ID NO: 534305 - RNA, 17 nt, Human
uuauguaaaauguagua

SEQ ID NO: 534306 - RNA, 18 nt, Human
uuauguaaaauugcggua

SEQ ID NO: 534307 - RNA, 18 nt, Human
uuauguaaacgucuggua

SEQ ID NO: 534308 - RNA, 18 nt, Human
uuauguaaauaccuagua

SEQ ID NO: 534309 - RNA, 32 nt, Human
uuauguaacuucacaucucugagaauggggga

SEQ ID NO: 534310 - RNA, 32 nt, Human
uuauguaagguaauuaugaaagacauugguga

SEQ ID NO: 534311 - RNA, 32 nt, Human
uuauguaaucaggacccacugcuguaugaguc

SEQ ID NO: 534312 - RNA, 18 nt, Human
uuauguaaugcauucagu

SEQ ID NO: 534313 - RNA, 32 nt, Human
uuauguacaagauggaaaauccccuaccccuc

SEQ ID NO: 534314 - RNA, 32 nt, Human
uuauguacuaccugauguguauaaggacaggu

SEQ ID NO: 534315 - RNA, 32 nt, Human
uuauguagaacuccaggagggacauuaaauca

SEQ ID NO: 534316 - RNA, 32 nt, Human
uuauguagaccagaagcugcaauauacaauga

SEQ ID NO: 534317 - RNA, 32 nt, Human
uuauguagguauuguuaaaaggcuagagccua

SEQ ID NO: 534318 - RNA, 32 nt, Human
uuauguaguuuaggcuggaaaugguuucacuu

SEQ ID NO: 534319 - RNA, 32 nt, Human
uuauguauaagaaugcuuuuuaaagcacaugu

SEQ ID NO: 534320 - RNA, 32 nt, Human
uuauguauuaacauggcguguuuauuuuugua

SEQ ID NO: 534321 - RNA, 32 nt, Human
uuauguauuauccacacgauguuuucacagag

SEQ ID NO: 534322 - RNA, 32 nt, Human
uuauguauuuauuuucuuguugccucaaaaga

SEQ ID NO: 534323 - RNA, 32 nt, Human
uuauguauuugguggagacaaugggaagacca

SEQ ID NO: 534324 - RNA, 32 nt, Human
uuaugucaagggcagcuuugcucauauuuccc

SEQ ID NO: 534325 - RNA, 31 nt, Human
uuaugucacagcuggccugcagcaggucccu

SEQ ID NO: 534326 - RNA, 32 nt, Human
uuaugucaccacugguaccucaguuuccucau

SEQ ID NO: 534327 - RNA, 32 nt, Human
uuaugucacugcacuccauccugggugacaag

SEQ ID NO: 534328 - RNA, 27 nt, Human
uuaugucacugcacuucucuacucuca

SEQ ID NO: 534329 - RNA, 32 nt, Human
uuaugucacugcagagguaugaaaaggagagc

SEQ ID NO: 534330 - RNA, 32 nt, Human
uuaugucagccaguguuucaggcacaggaagu

SEQ ID NO: 534331 - RNA, 32 nt, Human
uuaugucaggugaacuggcaugcugaacauau

SEQ ID NO: 534332 - RNA, 32 nt, Human
uuaugucagucugaugaacagauggcuuagcc

SEQ ID NO: 534333 - RNA, 32 nt, Human
uuaugucauagaaauuaauaugauacuuuaaa

SEQ ID NO: 534334 - RNA, 32 nt, Human
uuaugucauaggcuacuaugcaucagaaucac

SEQ ID NO: 534335 - RNA, 32 nt, Human
uuaugucaucccuucuucuccagacagaagau

SEQ ID NO: 534336 - RNA, 32 nt, Human
uuaugucaugaucuuaagcuuccugagguugc

SEQ ID NO: 534337 - RNA, 32 nt, Human
uuauguccaugaaaucaagagugugauguucu

SEQ ID NO: 534338 - RNA, 31 nt, Human
uuauguccccugccagggccugucucugacu

SEQ ID NO: 534339 - RNA, 32 nt, Human
uuauguccccuuauguuccugguacuggagcu

SEQ ID NO: 534340 - RNA, 32 nt, Human
uuaugucccuggcacaugaauaaacuuugcug

SEQ ID NO: 534341 - RNA, 32 nt, Human
uuauguccucuucucccuuuccaucuuucagc

SEQ ID NO: 534342 - RNA, 32 nt, Human
uuauguccugaacgugaaauucugucaacacu

SEQ ID NO: 534343 - RNA, 32 nt, Human
uuaugucucucugaccuaugggcuacuuggga

SEQ ID NO: 534344 - RNA, 32 nt, Human
uuaugucugcugucaugucugggucuuuaggg

SEQ ID NO: 534345 - RNA, 32 nt, Human
uuaugucugcuuguaaaaguuucaaaauaugu

SEQ ID NO: 534346 - RNA, 32 nt, Human
uuaugucuguaaucccagcacuuuugagaggc

SEQ ID NO: 534347 - RNA, 32 nt, Human
uuaugucuuaccagauagaguugcagggaagg

SEQ ID NO: 534348 - RNA, 32 nt, Human
uuaugucuucuccuaguacaaccaaacagaua

SEQ ID NO: 534349 - RNA, 32 nt, Human
uuaugucuucuuuucccuuuccaucuuucagc

SEQ ID NO: 534350 - RNA, 32 nt, Human
uuaugucuuucuccucuuccuauucugucauc

SEQ ID NO: 534351 - RNA, 32 nt, Human
uuaugugaaaucuaacuguaaugagguccuuu

SEQ ID NO: 534352 - RNA, 32 nt, Human
uuaugugaacaugcgcugugugcugcuugcuu

SEQ ID NO: 534353 - RNA, 32 nt, Human
uuaugugaaggaugaaaggugggugaaaggac

SEQ ID NO: 534354 - RNA, 32 nt, Human
uuaugugacucauguguccucuuagaauccca

SEQ ID NO: 534355 - RNA, 32 nt, Human
uuaugugacuucuuuuucuuuuaguucuauuc

SEQ ID NO: 534356 - RNA, 18 nt, Human
uuaugugagccuucagua

SEQ ID NO: 534357 - RNA, 32 nt, Human
uuaugugaucagauuucuguuuaggaagauca

SEQ ID NO: 534358 - RNA, 16 nt, Human
uuaugugauugcagua

SEQ ID NO: 534359 - RNA, 32 nt, Human
uuaugugcaagacuuuguguuguagucuagac

SEQ ID NO: 534360 - RNA, 32 nt, Human
uuaugugcaauacuuauuucaaacuuuugaaa

SEQ ID NO: 534361 - RNA, 32 nt, Human
uuaugugcccaucacucucagagaccacguuu

SEQ ID NO: 534362 - RNA, 32 nt, Human
uuaugugcuacgauuuaacugcagccuugaac

SEQ ID NO: 534363 - RNA, 32 nt, Human
uuaugugggguugucaaaacuccacucagcac

SEQ ID NO: 534364 - RNA, 32 nt, Human
uuaugugggugaugccuuuuucuuuuaagccc

SEQ ID NO: 534365 - RNA, 21 nt, Human
uuauguggucccacaccaccc

SEQ ID NO: 534366 - RNA, 32 nt, Human
uuaugugguguuuguagucugauagagcuuga

SEQ ID NO: 534367 - RNA, 32 nt, Human
uuauguguaguugucucucuucagacucucag

SEQ ID NO: 534368 - RNA, 32 nt, Human
uuauguguaugucggugugccuagguagcucc

SEQ ID NO: 534369 - RNA, 32 nt, Human
uuaugugucucagaauauuuuugaggcgaagg

SEQ ID NO: 534370 - RNA, 32 nt, Human
uuaugugugagcuuuggcaugaccccuaguac

SEQ ID NO: 534371 - RNA, 32 nt, Human
uuaugugugccaagggaguauuuucacaaagu

SEQ ID NO: 534372 - RNA, 32 nt, Human
uuaugugugccuggacacagacagagacagag

SEQ ID NO: 534373 - RNA, 32 nt, Human
uuauguguggcaggcacacagcuuugaauguu

SEQ ID NO: 534374 - RNA, 32 nt, Human
uuauguguggcaggcacgcagcuuugaauguu

SEQ ID NO: 534375 - RNA, 32 nt, Human
uuaugugugguggacugcagagcugcuuccac

SEQ ID NO: 534376 - RNA, 32 nt, Human
uuauguguugagaucagugacugcuggauagu

SEQ ID NO: 534377 - RNA, 32 nt, Human
uuauguguugggggagagauggagggguguug

SEQ ID NO: 534378 - RNA, 32 nt, Human
uuauguguuggugccaucgcacaugcucaaua

SEQ ID NO: 534379 - RNA, 32 nt, Human
uuauguguuucugcuaauagaggaaucauagc

SEQ ID NO: 534380 - RNA, 22 nt, Human
uuauguguuugucaauguacug

SEQ ID NO: 534381 - RNA, 32 nt, Human
uuauguuaagacuaucaaacacaguguugccu

SEQ ID NO: 534382 - RNA, 32 nt, Human
uuauguuacaauauucuuuauuccuaucuagu

SEQ ID NO: 534383 - RNA, 32 nt, Human
uuauguuaucaccccaccacuaccuccauggu

SEQ ID NO: 534384 - RNA, 32 nt, Human
uuauguucaagcaauucuccuuccuuagccuc

SEQ ID NO: 534385 - RNA, 32 nt, Human
uuauguucaaggugagaauaagaaauagccaa

SEQ ID NO: 534386 - RNA, 32 nt, Human
uuauguucacugcacucugauuuucuguaggu

SEQ ID NO: 534387 - RNA, 32 nt, Human
uuauguucagaagcugucccacugugguaaaa

SEQ ID NO: 534388 - RNA, 32 nt, Human
uuauguucauucuccuuaauuccuuaacaauc

SEQ ID NO: 534389 - RNA, 32 nt, Human
uuauguuccagcguuuucuacucugaauaguu

SEQ ID NO: 534390 - RNA, 32 nt, Human
uuauguucccuuucuggcauagcauucacuug

SEQ ID NO: 534391 - RNA, 32 nt, Human
uuauguucuaguucuugaaagaggcagugagg

SEQ ID NO: 534392 - RNA, 32 nt, Human
uuauguucucagagagauuaauugcuaccgcu

SEQ ID NO: 534393 - RNA, 32 nt, Human
uuauguucuccucugcccgaagucccugucag

SEQ ID NO: 534394 - RNA, 32 nt, Human
uuauguucugguugaaaucaccugugugucuu

SEQ ID NO: 534395 - RNA, 32 nt, Human
uuauguucuguguuauuuuaucuuuaauuaau

SEQ ID NO: 534396 - RNA, 32 nt, Human
uuauguucuucauuaaaaaucuuaucuuggac

SEQ ID NO: 534397 - RNA, 32 nt, Human
uuauguucuugcauuauaauuuuauccuaacc

SEQ ID NO: 534398 - RNA, 32 nt, Human
uuauguugacaaauuauuuaaaggaauuacug

SEQ ID NO: 534399 - RNA, 32 nt, Human
uuauguugcaccacugugaaggucuagaugca

SEQ ID NO: 534400 - RNA, 32 nt, Human
uuauguugcaguaacguacaaccucaucauuu

SEQ ID NO: 534401 - RNA, 32 nt, Human
uuauguugcauuuucucagcuccuggggaugg

SEQ ID NO: 534402 - RNA, 32 nt, Human
uuauguugcuccaguaaaaucuugccuggaaa

SEQ ID NO: 534403 - RNA, 32 nt, Human
uuauguuggccaggcuggucuccaacuccuga

SEQ ID NO: 534404 - RNA, 30 nt, Human
uuauguugggagguaggggcacaauuguca

SEQ ID NO: 534405 - RNA, 32 nt, Human
uuauguugggcaagacuguaagauggcugauc

SEQ ID NO: 534406 - RNA, 32 nt, Human
uuauguuuagggagaccaggaggagacaugga

SEQ ID NO: 534407 - RNA, 32 nt, Human
uuauguuuauucaccagucuuugauuaaauaa

SEQ ID NO: 534408 - RNA, 32 nt, Human
uuauguuuauucaccagucuuugauuaaauua

SEQ ID NO: 534409 - RNA, 32 nt, Human
uuauguuuucagugcugugucauuccaaauaa

SEQ ID NO: 534410 - RNA, 32 nt, Human
uuauuaaaagcagcacagauuccacauuuuua

SEQ ID NO: 534411 - RNA, 32 nt, Human
uuauuaaaauaacauaauugagggaccaucag

SEQ ID NO: 534412 - RNA, 32 nt, Human
uuauuaaacaaagcuccuacugccaucauacu

SEQ ID NO: 534413 - RNA, 32 nt, Human
uuauuaaacugaauaguucaggagacuuuaca

SEQ ID NO: 534414 - RNA, 32 nt, Human
uuauuaaagcuguaucucugaagacuguguca

SEQ ID NO: 534415 - RNA, 21 nt, Human
uuauuaaaggaaauccaugug

SEQ ID NO: 534416 - RNA, 32 nt, Human
uuauuaaauuuagucauaaucaucucaaggac

SEQ ID NO: 534417 - RNA, 32 nt, Human
uuauuaacaauucccccagaacauggaaauaa

SEQ ID NO: 534418 - RNA, 32 nt, Human
uuauuaaccaguaguguggaaauacuaguuuu

SEQ ID NO: 534419 - RNA, 32 nt, Human
uuauuaaccauggucugagaguuguuuuuguu

SEQ ID NO: 534420 - RNA, 32 nt, Human
uuauuaagacagcaucuugcuccucacccagg

SEQ ID NO: 534421 - RNA, 32 nt, Human
uuauuaaguacauuugaauugucuccugacua

SEQ ID NO: 534422 - RNA, 32 nt, Human
uuauuaaguuuuuaauucauagucacuaaaga

SEQ ID NO: 534423 - RNA, 32 nt, Human
uuauuaauaacaaaauacaauucuucccucua

SEQ ID NO: 534424 - RNA, 32 nt, Human
uuauuaaucauaggagcuugcagucucacuag

SEQ ID NO: 534425 - RNA, 32 nt, Human
uuauuaauguuuuucauguaacaaacuaaacu

SEQ ID NO: 534426 - RNA, 32 nt, Human
uuauuacaaaauagaauucaauaaccauauug

SEQ ID NO: 534427 - RNA, 22 nt, Human
uuauuacaaagacccaaaugaa

SEQ ID NO: 534428 - RNA, 32 nt, Human
uuauuacaaaggaguagggaugauaggaucug

SEQ ID NO: 534429 - RNA, 32 nt, Human
uuauuacaaaggauauuaugaaggaaacagau

SEQ ID NO: 534430 - RNA, 32 nt, Human
uuauuacaagaagcaacagguuauugacauua

SEQ ID NO: 534431 - RNA, 32 nt, Human
uuauuacaauuucaaagcuacacuucauuaaa

SEQ ID NO: 534432 - RNA, 32 nt, Human
uuauuacauucucuuuuucucucccaugacua

SEQ ID NO: 534433 - RNA, 32 nt, Human
uuauuacauugaauuauauaaagugcauguua

SEQ ID NO: 534434 - RNA, 32 nt, Human
uuauuacauugucaauuaugcauuuguaauuu

SEQ ID NO: 534435 - RNA, 22 nt, Human
uuauuacauuugugucaaugaa

SEQ ID NO: 534436 - RNA, 32 nt, Human
uuauuaccagagaauuuuauuugguugcuuuu

SEQ ID NO: 534437 - RNA, 32 nt, Human
uuauuacccacuggguaacagugguuacccac

SEQ ID NO: 534438 - RNA, 32 nt, Human
uuauuaccguccccuucauuguuuucaaagac

SEQ ID NO: 534439 - RNA, 32 nt, Human
uuauuaccuuucacuauuuauaauaaaggaau

SEQ ID NO: 534440 - RNA, 32 nt, Human
uuauuacgucauaaaccauugaaaacacaucu

SEQ ID NO: 534441 - RNA, 32 nt, Human
uuauuacuaaugcucugaucuguccaaacuca

SEQ ID NO: 534442 - RNA, 32 nt, Human
uuauuacuacugcuuuacugccuguagcaggu

SEQ ID NO: 534443 - RNA, 32 nt, Human
uuauuacucaauucaagaaaagaaagggcuaa

SEQ ID NO: 534444 - RNA, 32 nt, Human
uuauuacuccuuaaccacuugcauucuggcuu

SEQ ID NO: 534445 - RNA, 32 nt, Human
uuauuacuuuguaauaugccacugugaguacu

SEQ ID NO: 534446 - RNA, 32 nt, Human
uuauuagaaauacauuuaaaaacaucgaguac

SEQ ID NO: 534447 - RNA, 32 nt, Human
uuauuagaaaugcagaaucugaagccccacuc

SEQ ID NO: 534448 - RNA, 32 nt, Human
uuauuagaauaucagcugcuuccuccucuggu

SEQ ID NO: 534449 - RNA, 32 nt, Human
uuauuagaccaaaagaggaagaggucguggua

SEQ ID NO: 534450 - RNA, 32 nt, Human
uuauuagagacaggguuucuccguguugguca

SEQ ID NO: 534451 - RNA, 32 nt, Human
uuauuagagacaggguuucuucauguugguca

SEQ ID NO: 534452 - RNA, 32 nt, Human
uuauuagcaaacauagcuggauuaagacaaag

SEQ ID NO: 534453 - RNA, 32 nt, Human
uuauuagcacaaaaucauucuuugcaacucaa

SEQ ID NO: 534454 - RNA, 32 nt, Human
uuauuagcacuucccgccccagggcacuacau

SEQ ID NO: 534455 - RNA, 32 nt, Human
uuauuagccaugugaacuuggccacaucacuu

SEQ ID NO: 534456 - RNA, 32 nt, Human
uuauuagccugaugaaugugaauugauuccug

SEQ ID NO: 534457 - RNA, 32 nt, Human
uuauuagcuuuguguguguccucuucccccaa

SEQ ID NO: 534458 - RNA, 32 nt, Human
uuauuaggaagaggaagaagagguagaaaaca

SEQ ID NO: 534459 - RNA, 32 nt, Human
uuauuaguagacaaagaggauguggauaauau

SEQ ID NO: 534460 - RNA, 32 nt, Human
uuauuaguccuagugugaaagcauuaauauua

SEQ ID NO: 534461 - RNA, 32 nt, Human
uuauuagugaaagagaccuguggauugaaaug

SEQ ID NO: 534462 - RNA, 32 nt, Human
uuauuagugauuaucucauaauuuuauuuucu

SEQ ID NO: 534463 - RNA, 32 nt, Human
uuauuaguucaacaaacuaauuuugagagagc

SEQ ID NO: 534464 - RNA, 32 nt, Human
uuauuaguuuuuaaaaucaguacuuuuuaaau

SEQ ID NO: 534465 - RNA, 32 nt, Human
uuauuaguuuuuaaaaucaguacuuuuuaaug

SEQ ID NO: 534466 - RNA, 32 nt, Human
uuauuaguuuuuaaaaucaguacuuuuuacug

SEQ ID NO: 534467 - RNA, 32 nt, Human
uuauuauacaauguagugaguccugcaugggu

SEQ ID NO: 534468 - RNA, 32 nt, Human
uuauuauagacggguuucaccauguuggccag

SEQ ID NO: 534469 - RNA, 32 nt, Human
uuauuauagguaaucaaugaauauugaaguuu

SEQ ID NO: 534470 - RNA, 32 nt, Human
uuauuauaugguaaagaggaaaaaggaaauac

SEQ ID NO: 534471 - RNA, 32 nt, Human
uuauuaucaaauacuucaauguagauauuucu

SEQ ID NO: 534472 - RNA, 32 nt, Human
uuauuaucaguuuaucuuucucccacuccacu

SEQ ID NO: 534473 - RNA, 32 nt, Human
uuauuauccaucggguuaccaugguaauccac

SEQ ID NO: 534474 - RNA, 32 nt, Human
uuauuaucuauguuacaaacccaaccauacag

SEQ ID NO: 534475 - RNA, 32 nt, Human
uuauuaucuuucucccuguuacuuggcugggg

SEQ ID NO: 534476 - RNA, 32 nt, Human
uuauuaugagccaggagauggggacugugaca

SEQ ID NO: 534477 - RNA, 32 nt, Human
uuauuaugaugguuguaaugaagauuaugagu

SEQ ID NO: 534478 - RNA, 32 nt, Human
uuauuaugcacauuguuuuuccugccuuuuua

SEQ ID NO: 534479 - RNA, 32 nt, Human
uuauuauggaaaacauuucaaguuuacuccuu

SEQ ID NO: 534480 - RNA, 29 nt, Human
uuauuauggcugcuguuguccaacagaac

SEQ ID NO: 534481 - RNA, 32 nt, Human
uuauuauguauguacaccauauaugaauaaac

SEQ ID NO: 534482 - RNA, 29 nt, Human
uuauuaugucuguguucccuugggacuca

SEQ ID NO: 534483 - RNA, 32 nt, Human
uuauuauguguauccccagcuauguaugcagc

SEQ ID NO: 534484 - RNA, 32 nt, Human
uuauuauuaaagauugcuugguagugaaaagg

SEQ ID NO: 534485 - RNA, 32 nt, Human
uuauuauuaacugcucuuuuucccucuggugg

SEQ ID NO: 534486 - RNA, 32 nt, Human
uuauuauuguaauuagaucuucacaaaguugu

SEQ ID NO: 534487 - RNA, 32 nt, Human
uuauuauuguauucaaaauucauuguguauau

SEQ ID NO: 534488 - RNA, 32 nt, Human
uuauuauuguucucauuuuauagaugagaaag

SEQ ID NO: 534489 - RNA, 32 nt, Human
uuauuauuuaguuuuuacaguaacaugaauaa

SEQ ID NO: 534490 - RNA, 32 nt, Human
uuauuauuucaagggucacacaggguuaaguu

SEQ ID NO: 534491 - RNA, 32 nt, Human
uuauuauuugagauggagucucacucugucac

SEQ ID NO: 534492 - RNA, 32 nt, Human
uuauuauuugugauguucugucuuccuuguca

SEQ ID NO: 534493 - RNA, 32 nt, Human
uuauucaaaaucacugcuaucuuugggacuaa

SEQ ID NO: 534494 - RNA, 32 nt, Human
uuauucaaaaugaucagugccaggagauggac

SEQ ID NO: 534495 - RNA, 32 nt, Human
uuauucaaagaaauaucugagcucuuugcacu

SEQ ID NO: 534496 - RNA, 32 nt, Human
uuauucaaccuacaggaggccacugcaucaac

SEQ ID NO: 534497 - RNA, 32 nt, Human
uuauucaagugcuugcccagugcuucuugaaa

SEQ ID NO: 534498 - RNA, 32 nt, Human
uuauucacauuugucugcuggaagaguuuauc

SEQ ID NO: 534499 - RNA, 32 nt, Human
uuauucaccaauaaauuauugacuacagagca

SEQ ID NO: 534500 - RNA, 32 nt, Human
uuauucacgacacacuucuucccuucacucuc

SEQ ID NO: 534501 - RNA, 32 nt, Human
uuauucagaaaugguagcuauucuauaccuau

SEQ ID NO: 534502 - RNA, 32 nt, Human
uuauucagguauaaaaacaagagaucauaaua

SEQ ID NO: 534503 - RNA, 32 nt, Human
uuauucaguaggaacucucuucugccugguuu

SEQ ID NO: 534504 - RNA, 32 nt, Human
uuauucagugugaccaggaugggcgggagggg

SEQ ID NO: 534505 - RNA, 32 nt, Human
uuauucaguuuuuaaagggaaaaagggcguga

SEQ ID NO: 534506 - RNA, 32 nt, Human
uuauucauacaaaacuaauuacuggauuuauu

SEQ ID NO: 534507 - RNA, 32 nt, Human
uuauucauagcauugugggucucuccaguaag

SEQ ID NO: 534508 - RNA, 32 nt, Human
uuauucauauccagcacucccugcggcugcug

SEQ ID NO: 534509 - RNA, 32 nt, Human
uuauucaucaccaggcuguaagcaauaucuug

SEQ ID NO: 534510 - RNA, 32 nt, Human
uuauucaucccucccucuccuuuaacccuuag

SEQ ID NO: 534511 - RNA, 31 nt, Human
uuauucaugcucucuggcugccuuuguagac

SEQ ID NO: 534512 - RNA, 32 nt, Human
uuauucaugucccagaagaccaaaaagugcuc

SEQ ID NO: 534513 - RNA, 32 nt, Human
uuauucauguuaucacugagcagcgggaacug

SEQ ID NO: 534514 - RNA, 32 nt, Human
uuauucauguuauuuucccugcccaagacuuu

SEQ ID NO: 534515 - RNA, 32 nt, Human
uuauucauuuagcuggcaacugccuuuauugc

SEQ ID NO: 534516 - RNA, 32 nt, Human
uuauuccaacacacccggcccagccuuaaccc

SEQ ID NO: 534517 - RNA, 32 nt, Human
uuauuccacagagucaagaccaauauucugcc

SEQ ID NO: 534518 - RNA, 32 nt, Human
uuauuccagagcugccaguggggccugaggcu

SEQ ID NO: 534519 - RNA, 32 nt, Human
uuauuccagagggaggcuuggaucagcaccug

SEQ ID NO: 534520 - RNA, 32 nt, Human
uuauuccagauggggaaacugaggcucaggug

SEQ ID NO: 534521 - RNA, 32 nt, Human
uuauuccagcuccuauguucuguguauaucau

SEQ ID NO: 534522 - RNA, 32 nt, Human
uuauuccaggaucaguagaaucacagaggguu

SEQ ID NO: 534523 - RNA, 32 nt, Human
uuauuccauccuguaauccuagcacuuuaaaa

SEQ ID NO: 534524 - RNA, 32 nt, Human
uuauucccaaggacagugcugacggggagggg

SEQ ID NO: 534525 - RNA, 32 nt, Human
uuauucccacagaauuuggugauguccuuauu

SEQ ID NO: 534526 - RNA, 23 nt, Human
uuauucccaggcuggagugcaau

SEQ ID NO: 534527 - RNA, 32 nt, Human
uuauucccagugaaaguggcucucagcaggaa

SEQ ID NO: 534528 - RNA, 32 nt, Human
uuauucccaucuuuacccccaagacuuuauug

SEQ ID NO: 534529 - RNA, 32 nt, Human
uuauucccaucuuuacucccaagacuucauug

SEQ ID NO: 534530 - RNA, 32 nt, Human
uuauuccccagcccugggaaauaggagcuguc

SEQ ID NO: 534531 - RNA, 32 nt, Human
uuauuccccagcugcccucuccagcucccucc

SEQ ID NO: 534532 - RNA, 32 nt, Human
uuauucccccucaaagaaaccccacuaguagu

SEQ ID NO: 534533 - RNA, 32 nt, Human
uuauucccugaggcucccuugacucaggacug

SEQ ID NO: 534534 - RNA, 32 nt, Human
uuauucccuuaggauagucucucagugccaag

SEQ ID NO: 534535 - RNA, 32 nt, Human
uuauucccuuuuucucuuccucacuuuauugc

SEQ ID NO: 534536 - RNA, 32 nt, Human
uuauuccgaucugacauaucugcauuauaaua

SEQ ID NO: 534537 - RNA, 32 nt, Human
uuauuccuaagaggagaaaaucaguaacggga

SEQ ID NO: 534538 - RNA, 32 nt, Human
uuauuccuaauucugccccuuuuaaccugaug

SEQ ID NO: 534539 - RNA, 32 nt, Human
uuauuccucauucuguggauguuucuaugagc

SEQ ID NO: 534540 - RNA, 32 nt, Human
uuauuccucccucaugagcacagggucggggg

SEQ ID NO: 534541 - RNA, 32 nt, Human
uuauuccuccuuugcugauccugggucacacu

SEQ ID NO: 534542 - RNA, 32 nt, Human
uuauuccucuugaaguuaguuugauuuuaucu

SEQ ID NO: 534543 - RNA, 32 nt, Human
uuauuccugccuguguugcccaccuguucaca

SEQ ID NO: 534544 - RNA, 32 nt, Human
uuauuccuggugucagggagauuaggaaacac

SEQ ID NO: 534545 - RNA, 32 nt, Human
uuauuccuguaaucccaacacuguggaaggcc

SEQ ID NO: 534546 - RNA, 32 nt, Human
uuauuccuuacucaugaacagugucggcgcac

SEQ ID NO: 534547 - RNA, 32 nt, Human
uuauucgagcauacuggcaaugcauuggaaaa

SEQ ID NO: 534548 - RNA, 32 nt, Human
uuauucgcuaguagcggcuacuuuaaaaugcu

SEQ ID NO: 534549 - RNA, 32 nt, Human
uuauucgucuucuccccauuccgcugccgccg

SEQ ID NO: 534550 - RNA, 20 nt, Human
uuauucuaacaauuacauga

SEQ ID NO: 534551 - RNA, 32 nt, Human
uuauucuacuccugcaaugaacccuguugaca

SEQ ID NO: 534552 - RNA, 32 nt, Human
uuauucuagaggucucucuggaaaagauggag

SEQ ID NO: 534553 - RNA, 32 nt, Human
uuauucuagccugucaugagucugucugagca

SEQ ID NO: 534554 - RNA, 32 nt, Human
uuauucuauauugcuuaccugaucucauguua

SEQ ID NO: 534555 - RNA, 32 nt, Human
uuauucuaucgguauaaaggcauugauauuuu

SEQ ID NO: 534556 - RNA, 32 nt, Human
uuauucucaaagcucaaucaagacacccagua

SEQ ID NO: 534557 - RNA, 32 nt, Human
uuauucucagcacccagaacagugccuggcac

SEQ ID NO: 534558 - RNA, 32 nt, Human
uuauucuccucuuccuuuuacccuagucucac

SEQ ID NO: 534559 - RNA, 32 nt, Human
uuauucucuccaaagcuggucuuucugacuau

SEQ ID NO: 534560 - RNA, 32 nt, Human
uuauucucuuccaggauuuguguuuuguucuu

SEQ ID NO: 534561 - RNA, 32 nt, Human
uuauucucuuucuucugaccuccuugccucuu

SEQ ID NO: 534562 - RNA, 32 nt, Human
uuauucucuuuuguaacugcugucuuuacaau

SEQ ID NO: 534563 - RNA, 32 nt, Human
uuauucugagucugacacagacccaugacaug

SEQ ID NO: 534564 - RNA, 32 nt, Human
uuauucugcuuccacuguguuggggagaggug

SEQ ID NO: 534565 - RNA, 32 nt, Human
uuauucuggagacaagaaaaucaucacucugg

SEQ ID NO: 534566 - RNA, 32 nt, Human
uuauucuguaucaucaccaguacuuuguacuu

SEQ ID NO: 534567 - RNA, 32 nt, Human
uuauucugugacuugcuggagguuggcagugg

SEQ ID NO: 534568 - RNA, 32 nt, Human
uuauucuguggaaagaaaaaccuguaaagugu

SEQ ID NO: 534569 - RNA, 32 nt, Human
uuauucuguguguagacauuguauuccacaau

SEQ ID NO: 534570 - RNA, 32 nt, Human
uuauucuuaaagucggcgagaccaacaaccca

SEQ ID NO: 534571 - RNA, 32 nt, Human
uuauucuucaaacuaucuaaacuagucaugga

SEQ ID NO: 534572 - RNA, 32 nt, Human
uuauucuucaacaacaguaacuaaucuuuaaa

SEQ ID NO: 534573 - RNA, 32 nt, Human
uuauucuucuuacuuaaucucagaccuugguc

SEQ ID NO: 534574 - RNA, 32 nt, Human
uuauucuugaaacugagguuuaccuggaucug

SEQ ID NO: 534575 - RNA, 32 nt, Human
uuauucuugcaucuuauuaauuuucuaugaua

SEQ ID NO: 534576 - RNA, 32 nt, Human
uuauucuuggugcugccugggguguugcugag

SEQ ID NO: 534577 - RNA, 32 nt, Human
uuauucuuugaccuucccacaagacaauaccc

SEQ ID NO: 534578 - RNA, 32 nt, Human
uuauucuuugccuuguucucugugaaguccuu

SEQ ID NO: 534579 - RNA, 32 nt, Human
uuauucuuugcuagccucucuuacuaauggaa

SEQ ID NO: 534580 - RNA, 32 nt, Human
uuauucuuugggccuugagcagguuaguaguc

SEQ ID NO: 534581 - RNA, 32 nt, Human
uuauugaaaagaggaggggaaaggucuauaaa

SEQ ID NO: 534582 - RNA, 32 nt, Human
uuauugaaaugaggcuguggauucaaggcucc

SEQ ID NO: 534583 - RNA, 32 nt, Human
uuauugaaggcccuguggacagcugggauagc

SEQ ID NO: 534584 - RNA, 32 nt, Human
uuauugacacuacaaguggcccacagggagcc

SEQ ID NO: 534585 - RNA, 32 nt, Human
uuauugacuacaagugcucacagacuagaacu

SEQ ID NO: 534586 - RNA, 32 nt, Human
uuauugagaaaagguuguaggaugugucacaa

SEQ ID NO: 534587 - RNA, 32 nt, Human
uuauugagaucuaagucugucuugccuucauu

SEQ ID NO: 534588 - RNA, 32 nt, Human
uuauugagcaaauguguuccuuucuucuaaaa

SEQ ID NO: 534589 - RNA, 32 nt, Human
uuauugagcaccuacuaugugccagccacugu

SEQ ID NO: 534590 - RNA, 32 nt, Human
uuauugagcaccuacuaugugcccagcccugu

SEQ ID NO: 534591 - RNA, 32 nt, Human
uuauugagugaaucauuaggacacaaaauagg

SEQ ID NO: 534592 - RNA, 32 nt, Human
uuauugagugccuguugcauacaggcacaauc

SEQ ID NO: 534593 - RNA, 32 nt, Human
uuauugagugggagacaggcggcaggugggag

SEQ ID NO: 534594 - RNA, 32 nt, Human
uuauugauaaaguuagggagaagauugaugca

SEQ ID NO: 534595 - RNA, 32 nt, Human
uuauugauacaacaggauuuucaaguuauuca

SEQ ID NO: 534596 - RNA, 32 nt, Human
uuauugauauggugagccccaucucucaguuu

SEQ ID NO: 534597 - RNA, 32 nt, Human
uuauugauuaacugcaacgagucaucucccug

SEQ ID NO: 534598 - RNA, 32 nt, Human
uuauugauuuuacuggcacuguauuuggaccu

SEQ ID NO: 534599 - RNA, 32 nt, Human
uuauugcaaccauauuggcaaucugaaacugg

SEQ ID NO: 534600 - RNA, 32 nt, Human
uuauugcaaugcggagguugagaggaggacuu

SEQ ID NO: 534601 - RNA, 32 nt, Human
uuauugcaccacugaacuccagccugggccac

SEQ ID NO: 534602 - RNA, 32 nt, Human
uuauugcacuacugcauuccagccugggugac

SEQ ID NO: 534603 - RNA, 32 nt, Human
uuauugcaugaagucccucucacucccucuac

SEQ ID NO: 534604 - RNA, 32 nt, Human
uuauugccacugagacagaaacagcagaaauc

SEQ ID NO: 534605 - RNA, 32 nt, Human
uuauugccaguggagacuggugagcugggccu

SEQ ID NO: 534606 - RNA, 32 nt, Human
uuauugcccaggcuagagugcaauggugcgau

SEQ ID NO: 534607 - RNA, 24 nt, Human
uuauugcccaggcuggagugcaau

SEQ ID NO: 534608 - RNA, 32 nt, Human
uuauugcccaggcuggagugcaauggcacgac

SEQ ID NO: 534609 - RNA, 32 nt, Human
uuauugcccaggcuggagugcaauggcacgau

SEQ ID NO: 534610 - RNA, 32 nt, Human
uuauugcccaggcuggagugcaauggugcaau

SEQ ID NO: 534611 - RNA, 23 nt, Human
uuauugcccaggcuggagugcag

SEQ ID NO: 534612 - RNA, 24 nt, Human
uuauugcccaggcuggagugcagu

SEQ ID NO: 534613 - RNA, 32 nt, Human
uuauugcccaggcuggagugcagugacgaggu

SEQ ID NO: 534614 - RNA, 32 nt, Human
uuauugcccaggcuggagugcaguggcacaau

SEQ ID NO: 534615 - RNA, 32 nt, Human
uuauugcccaggcuggagugcaguggcgugau

SEQ ID NO: 534616 - RNA, 32 nt, Human
uuauugcccaggcuggaguguaguggcgcaau

SEQ ID NO: 534617 - RNA, 22 nt, Human
uuauugcccaggcuugagugca

SEQ ID NO: 534618 - RNA, 24 nt, Human
uuauugcccaggcuugagugcaau

SEQ ID NO: 534619 - RNA, 32 nt, Human
uuauugcccaggcuugagugcaaugaccuguu

SEQ ID NO: 534620 - RNA, 22 nt, Human
uuauugccccaaccauugcaau

SEQ ID NO: 534621 - RNA, 32 nt, Human
uuauugcccuguccucaaacuggucauaggcu

SEQ ID NO: 534622 - RNA, 32 nt, Human
uuauugccucuaaaggccucagaagagcacac

SEQ ID NO: 534623 - RNA, 32 nt, Human
uuauugccuuuguuguuguauuacaaaucugc

SEQ ID NO: 534624 - RNA, 32 nt, Human
uuauugcgggauacuugugaaauauacauagg

SEQ ID NO: 534625 - RNA, 32 nt, Human
uuauugcgucuugcuccugggucacagagccu

SEQ ID NO: 534626 - RNA, 32 nt, Human
uuauugcuacuuccugccuggucuccugcccc

SEQ ID NO: 534627 - RNA, 32 nt, Human
uuauugcucacgucugugccauguugucaaug

SEQ ID NO: 534628 - RNA, 32 nt, Human
uuauugcucauuuguauaucuaucuaccauca

SEQ ID NO: 534629 - RNA, 32 nt, Human
uuauugcugcagaaaacaaaagccuggcugag

SEQ ID NO: 534630 - RNA, 32 nt, Human
uuauugcugcuuccagaccagagucccucccu

SEQ ID NO: 534631 - RNA, 32 nt, Human
uuauugcuggcucaaggaaaauucuuugaaau

SEQ ID NO: 534632 - RNA, 32 nt, Human
uuauugcuguggucuuucuacuccacaaaaua

SEQ ID NO: 534633 - RNA, 32 nt, Human
uuauugcuguuuucuuccuuccuuggauacuu

SEQ ID NO: 534634 - RNA, 32 nt, Human
uuauugcuuaaaacaugaagacugcuuucuuu

SEQ ID NO: 534635 - RNA, 32 nt, Human
uuauugcuucuucucccaucugcccguugaca

SEQ ID NO: 534636 - RNA, 32 nt, Human
uuauugcuuuugcccaugcauucaauauugau

SEQ ID NO: 534637 - RNA, 32 nt, Human
uuauuggaaagaggagacagaaugacaagaua

SEQ ID NO: 534638 - RNA, 31 nt, Human
uuauuggaacaauguacuacuugaguaauac

SEQ ID NO: 534639 - RNA, 32 nt, Human
uuauuggaagcauggauguuagugaaaguuac

SEQ ID NO: 534640 - RNA, 32 nt, Human
uuauuggaagcugauucccagagcagaccaca

SEQ ID NO: 534641 - RNA, 32 nt, Human
uuauuggagacaggguuucaccauguuggcca

SEQ ID NO: 534642 - RNA, 32 nt, Human
uuauuggaggaaguauugagugugugcucuca

SEQ ID NO: 534643 - RNA, 32 nt, Human
uuauuggaggaccuggcucaaggggcugcgcg

SEQ ID NO: 534644 - RNA, 32 nt, Human
uuauuggauaauagucuccugcucugacugga

SEQ ID NO: 534645 - RNA, 32 nt, Human
uuauuggcaacaaaaggaauuuucuauccaga

SEQ ID NO: 534646 - RNA, 32 nt, Human
uuauugggaggaaaggaggcagcugcagaauu

SEQ ID NO: 534647 - RNA, 32 nt, Human
uuauugggcaccuacuaugugccaggcacugu

SEQ ID NO: 534648 - RNA, 32 nt, Human
uuauuggguagucgauuggagacuuugauuuu

SEQ ID NO: 534649 - RNA, 32 nt, Human
uuauuggugaugacacguuucuuaaguaggag

SEQ ID NO: 534650 - RNA, 32 nt, Human
uuauugguggagggcuguuuuaacaucuuuga

SEQ ID NO: 534651 - RNA, 32 nt, Human
uuauugguggcuguuccugaaggaggcccugc

SEQ ID NO: 534652 - RNA, 32 nt, Human
uuauuguacacauuuaacacacaguagcaaau

SEQ ID NO: 534653 - RNA, 32 nt, Human
uuauuguagucauccuggaauaucuccgucaa

SEQ ID NO: 534654 - RNA, 32 nt, Human
uuauuguaugcccggaguuugcaugagauuuu

SEQ ID NO: 534655 - RNA, 32 nt, Human
uuauuguauguacaaauagagaauggaagaac

SEQ ID NO: 534656 - RNA, 32 nt, Human
uuauuguccauugagccuguacucugcuuucc

SEQ ID NO: 534657 - RNA, 32 nt, Human
uuauugucguacuuggacccagaaggggaaau

SEQ ID NO: 534658 - RNA, 32 nt, Human
uuauugucuacuugaguuacuacuuucuaaaa

SEQ ID NO: 534659 - RNA, 32 nt, Human
uuauugucuaucuccccacucccagaauguaa

SEQ ID NO: 534660 - RNA, 32 nt, Human
uuauugugaaaguugugcuguuuucuaaguaa

SEQ ID NO: 534661 - RNA, 31 nt, Human
uuauugugacuucuccagcccuggucugaau

SEQ ID NO: 534662 - RNA, 32 nt, Human
uuauugugcagcagauccagagacagaggcag

SEQ ID NO: 534663 - RNA, 32 nt, Human
uuauugugcgcccgaacuuuucacacaagaau

SEQ ID NO: 534664 - RNA, 32 nt, Human
uuauugugcuccauugcaacuuuaugguucaa

SEQ ID NO: 534665 - RNA, 32 nt, Human
uuauugugcugugucugguccuaaguggagcc

SEQ ID NO: 534666 - RNA, 32 nt, Human
uuauugugguuaggaagcaauuucccaaugua

SEQ ID NO: 534667 - RNA, 32 nt, Human
uuauugugucugcagugcugaaaacagugcuc

SEQ ID NO: 534668 - RNA, 32 nt, Human
uuauuguguuuuuaugcuguuuuauacuuuuu

SEQ ID NO: 534669 - RNA, 32 nt, Human
uuauuguuaucauccauaggcauuggaaggaa

SEQ ID NO: 534670 - RNA, 32 nt, Human
uuauuguuuccucagaaugagggcaguaacuu

SEQ ID NO: 534671 - RNA, 32 nt, Human
uuauuuaaaacaguuuuacaagcacggccuac

SEQ ID NO: 534672 - RNA, 32 nt, Human
uuauuuaaaauggaacuaaagauagaaggagg

SEQ ID NO: 534673 - RNA, 32 nt, Human
uuauuuaaagagacaguacacucugaaagaac

SEQ ID NO: 534674 - RNA, 32 nt, Human
uuauuuaacaucuuuaauagcacagcaaacau

SEQ ID NO: 534675 - RNA, 32 nt, Human
uuauuuaaccauuguucuauuuggcauaaccc

SEQ ID NO: 534676 - RNA, 32 nt, Human
uuauuuaacucaugggagccucaguuuccuca

SEQ ID NO: 534677 - RNA, 32 nt, Human
uuauuuaacuuauuucaagggugcugugcuca

SEQ ID NO: 534678 - RNA, 32 nt, Human
uuauuuaagaagcaaaacacagcaccuuuacc

SEQ ID NO: 534679 - RNA, 32 nt, Human
uuauuuaagacugaauuagaacugagucauuc

SEQ ID NO: 534680 - RNA, 32 nt, Human
uuauuuaagcuacugccaucaaccccaccccc

SEQ ID NO: 534681 - RNA, 32 nt, Human
uuauuuaaguucaagagaaaaaguguacacac

SEQ ID NO: 534682 - RNA, 32 nt, Human
uuauuuacaaacaugucuacaaaaauagauua

SEQ ID NO: 534683 - RNA, 32 nt, Human
uuauuuacaaaugaccccaaaguauaagagua

SEQ ID NO: 534684 - RNA, 32 nt, Human
uuauuuacacucauuuuuaucuuggcugacag

SEQ ID NO: 534685 - RNA, 32 nt, Human
uuauuuacagccgcucccaggccuucucggaa

SEQ ID NO: 534686 - RNA, 32 nt, Human
uuauuuacaucuuuaucagguauccuccaguc

SEQ ID NO: 534687 - RNA, 32 nt, Human
uuauuuacaugccaccaaccaaccucagaaac

SEQ ID NO: 534688 - RNA, 32 nt, Human
uuauuuacaugccacuauuaagcugcuaauug

SEQ ID NO: 534689 - RNA, 32 nt, Human
uuauuuacauuacauacauacauuuacaacau

SEQ ID NO: 534690 - RNA, 32 nt, Human
uuauuuaccaaguaccaacaguagaaguaaca

SEQ ID NO: 534691 - RNA, 32 nt, Human
uuauuuaccaggcugugcgguggcaccagaca

SEQ ID NO: 534692 - RNA, 32 nt, Human
uuauuuacccuuuggcaucuuuauauuuguua

SEQ ID NO: 534693 - RNA, 32 nt, Human
uuauuuacugguuuguggccuuuuacugugcu

SEQ ID NO: 534694 - RNA, 32 nt, Human
uuauuuagcacaaaccaagcacaaaaguccuc

SEQ ID NO: 534695 - RNA, 32 nt, Human
uuauuuagccuucuuuaauuuuucucaccaau

SEQ ID NO: 534696 - RNA, 32 nt, Human
uuauuuagcgcugugugugugcucuuauuucc

SEQ ID NO: 534697 - RNA, 32 nt, Human
uuauuuagguauaaauggucaucuuauuauuu

SEQ ID NO: 534698 - RNA, 32 nt, Human
uuauuuaguaagauggagucucgcucuguugc

SEQ ID NO: 534699 - RNA, 32 nt, Human
uuauuuaguuauucuggguauuuccuauguaa

SEQ ID NO: 534700 - RNA, 32 nt, Human
uuauuuauauccuaaucuuggagcucagaaag

SEQ ID NO: 534701 - RNA, 32 nt, Human
uuauuuaucuuucuggguauuuuuauagcccu

SEQ ID NO: 534702 - RNA, 32 nt, Human
uuauuuaugauacugauuaguauaaaaacgua

SEQ ID NO: 534703 - RNA, 32 nt, Human
uuauuuauggccaguuuuggggccaguuuaug

SEQ ID NO: 534704 - RNA, 32 nt, Human
uuauuuaugucuguuuacgguugaggaauuca

SEQ ID NO: 534705 - RNA, 32 nt, Human
uuauuuauuacaguuacauuggagauuucauc

SEQ ID NO: 534706 - RNA, 31 nt, Human
uuauuuauucuccgagagguuggagacgucc

SEQ ID NO: 534707 - RNA, 32 nt, Human
uuauuuauuuauuuucuuguugccucaaaaga

SEQ ID NO: 534708 - RNA, 32 nt, Human
uuauuuauuugccguuuuaauuuauggauucu

SEQ ID NO: 534709 - RNA, 32 nt, Human
uuauuuauuuuuagguacauuaggcaagagac

SEQ ID NO: 534710 - RNA, 32 nt, Human
uuauuucaaaacugagaaauucaugggaauga

SEQ ID NO: 534711 - RNA, 32 nt, Human
uuauuucaaauuuggacauggcuagucgaggc

SEQ ID NO: 534712 - RNA, 32 nt, Human
uuauuucaaguuggacagaucuuggagauaau

SEQ ID NO: 534713 - RNA, 32 nt, Human
uuauuucaaucagcucugacacuuguuuagac

SEQ ID NO: 534714 - RNA, 32 nt, Human
uuauuucaauugacaauucugccuccucuuuu

SEQ ID NO: 534715 - RNA, 32 nt, Human
uuauuucacaccaguuccuccuuguuucaucu

SEQ ID NO: 534716 - RNA, 32 nt, Human
uuauuucacauauuaacucaugggccagugag

SEQ ID NO: 534717 - RNA, 32 nt, Human
uuauuucacugaagcugagauuauuagugaua

SEQ ID NO: 534718 - RNA, 32 nt, Human
uuauuucagauagcaaaagacaagccaaugaa

SEQ ID NO: 534719 - RNA, 32 nt, Human
uuauuucagaugauucaaauaucaaaaggaag

SEQ ID NO: 534720 - RNA, 28 nt, Human
uuauuucagguucaugccucauuacaca

SEQ ID NO: 534721 - RNA, 32 nt, Human
uuauuucagugaacugcuggaacucacacaug

SEQ ID NO: 534722 - RNA, 32 nt, Human
uuauuucaucaccaagauauuaagccuaguac

SEQ ID NO: 534723 - RNA, 32 nt, Human
uuauuuccacugcacgcuggugcugggagcgc

SEQ ID NO: 534724 - RNA, 32 nt, Human
uuauuuccagacagcuccuacucuuauggugg

SEQ ID NO: 534725 - RNA, 32 nt, Human
uuauuuccaggcauuuugggaaaaagaugcug

SEQ ID NO: 534726 - RNA, 32 nt, Human
uuauuuccauguucuaagaagguguugguacu

SEQ ID NO: 534727 - RNA, 32 nt, Human
uuauuucccaacacucccucuucccagauucu

SEQ ID NO: 534728 - RNA, 32 nt, Human
uuauuucccuggcaggcagccuugccagaagg

SEQ ID NO: 534729 - RNA, 32 nt, Human
uuauuucccuuggcauaaggucuuccaguuuu

SEQ ID NO: 534730 - RNA, 32 nt, Human
uuauuucccuuggcauaaugucuuccaguucu

SEQ ID NO: 534731 - RNA, 32 nt, Human
uuauuucccuuggcauaaugucuuccaguuuu

SEQ ID NO: 534732 - RNA, 32 nt, Human
uuauuuccuaccuuugcaucccuuccucauaa

SEQ ID NO: 534733 - RNA, 32 nt, Human
uuauuuccuuaaauguuuugccagccacuuac

SEQ ID NO: 534734 - RNA, 32 nt, Human
uuauuuccuucucuuuuaguaugagaaguggc

SEQ ID NO: 534735 - RNA, 32 nt, Human
uuauuuccuuuaggguacuguccuggucaaaa

SEQ ID NO: 534736 - RNA, 32 nt, Human
uuauuuccuuucccagagcaaaaguuuuuaau

SEQ ID NO: 534737 - RNA, 32 nt, Human
uuauuucuacccugucucuccccgccaccccc

SEQ ID NO: 534738 - RNA, 32 nt, Human
uuauuucuacuuuacaauuucucucuaaagca

SEQ ID NO: 534739 - RNA, 32 nt, Human
uuauuucuagaaaagcagcccagagucaguca

SEQ ID NO: 534740 - RNA, 32 nt, Human
uuauuucucagggagaucacagcaaccuaaau

SEQ ID NO: 534741 - RNA, 32 nt, Human
uuauuucucaucccucacccccucccaccuug

SEQ ID NO: 534742 - RNA, 31 nt, Human
uuauuucuccucucugagccucaguuucccu

SEQ ID NO: 534743 - RNA, 32 nt, Human
uuauuucuccugugucaguaguacaguguacg

SEQ ID NO: 534744 - RNA, 32 nt, Human
uuauuucuccuuggauacagauauauuuugua

SEQ ID NO: 534745 - RNA, 32 nt, Human
uuauuucugaaugauuuuuaggguaaauaaua

SEQ ID NO: 534746 - RNA, 32 nt, Human
uuauuucugagauguugaugugaacuguacau

SEQ ID NO: 534747 - RNA, 32 nt, Human
uuauuucuggugaggaaugaaagggccaagug

SEQ ID NO: 534748 - RNA, 32 nt, Human
uuauuucuggugcacuccucuccugagagugu

SEQ ID NO: 534749 - RNA, 32 nt, Human
uuauuucuuaaaauuucagaauagauauucac

SEQ ID NO: 534750 - RNA, 32 nt, Human
uuauuucuucagcuucauguaacccugacuga

SEQ ID NO: 534751 - RNA, 32 nt, Human
uuauuucuuugugauaacaaagagucuugguu

SEQ ID NO: 534752 - RNA, 32 nt, Human
uuauuugaaaccaguauuucauacaaacuugu

SEQ ID NO: 534753 - RNA, 32 nt, Human
uuauuugaaauguuaaugcucuuuagaaaaau

SEQ ID NO: 534754 - RNA, 32 nt, Human
uuauuugaagaaaagcauauugccaaaaauuc

SEQ ID NO: 534755 - RNA, 32 nt, Human
uuauuugaagaaugccugugaagccaggugug

SEQ ID NO: 534756 - RNA, 32 nt, Human
uuauuugaagcuugaaaaaugagcaggcggaa

SEQ ID NO: 534757 - RNA, 32 nt, Human
uuauuugaauacaggcauacaccauguaauaa

SEQ ID NO: 534758 - RNA, 32 nt, Human
uuauuugacaaaccaucaguguccacuauuug

SEQ ID NO: 534759 - RNA, 21 nt, Human
uuauuugaccucccacuaccc

SEQ ID NO: 534760 - RNA, 32 nt, Human
uuauuugacuuugcuuucuuugcuuauuugac

SEQ ID NO: 534761 - RNA, 32 nt, Human
uuauuugagaauuuuguuucaaagggauugcu

SEQ ID NO: 534762 - RNA, 32 nt, Human
uuauuugagauggaaucuugcuuugucagcca

SEQ ID NO: 534763 - RNA, 32 nt, Human
uuauuugagauggagucucacucugucaccca

SEQ ID NO: 534764 - RNA, 32 nt, Human
uuauuugagcuauuuaaacaacuuaaacaucu

SEQ ID NO: 534765 - RNA, 32 nt, Human
uuauuugaggagacgaagugaaaacaaaucua

SEQ ID NO: 534766 - RNA, 32 nt, Human
uuauuugaggcagucagucauugauuugcaaa

SEQ ID NO: 534767 - RNA, 32 nt, Human
uuauuugauuaaaauuauuucccacugaccua

SEQ ID NO: 534768 - RNA, 32 nt, Human
uuauuugcaaugagagagaugguuggccccga

SEQ ID NO: 534769 - RNA, 32 nt, Human
uuauuugccauauaucauccugggcuuacauu

SEQ ID NO: 534770 - RNA, 32 nt, Human
uuauuugccuccauggccuuugaacuugcaca

SEQ ID NO: 534771 - RNA, 32 nt, Human
uuauuugccuggcaagaaaaguuuauuucaca

SEQ ID NO: 534772 - RNA, 32 nt, Human
uuauuugcuacuuggagggguuguaagaaaag

SEQ ID NO: 534773 - RNA, 32 nt, Human
uuauuugcuccuucucuucaugccuguggcug

SEQ ID NO: 534774 - RNA, 32 nt, Human
uuauuugcuuauugccugucucccucuaucag

SEQ ID NO: 534775 - RNA, 32 nt, Human
uuauuugcuucaaaaggagaucuuuagaaaaa

SEQ ID NO: 534776 - RNA, 32 nt, Human
uuauuuggaaggaagcaggggcuguccacccu

SEQ ID NO: 534777 - RNA, 32 nt, Human
uuauuuggagugaccccagaggacaagacuac

SEQ ID NO: 534778 - RNA, 32 nt, Human
uuauuuggagugagaaaucaaggagacagagc

SEQ ID NO: 534779 - RNA, 32 nt, Human
uuauuuggcaggugccaaauauacggguuauc

SEQ ID NO: 534780 - RNA, 32 nt, Human
uuauuugggacuugagauuugcagugauacca

SEQ ID NO: 534781 - RNA, 32 nt, Human
uuauuugguacucuagggcugaaggaaaguac

SEQ ID NO: 534782 - RNA, 32 nt, Human
uuauuuggucuccuauguagcauuucagaaaa

SEQ ID NO: 534783 - RNA, 32 nt, Human
uuauuuguaaguaggcuggauaaauggugcuu

SEQ ID NO: 534784 - RNA, 32 nt, Human
uuauuuguacucuguguggcuuuuguuuuaga

SEQ ID NO: 534785 - RNA, 32 nt, Human
uuauuuguagcugccaggcuuucuguaaaaau

SEQ ID NO: 534786 - RNA, 32 nt, Human
uuauuuguagguccagaggucucccugagaag

SEQ ID NO: 534787 - RNA, 32 nt, Human
uuauuuguauagccacauaguauuccauuaua

SEQ ID NO: 534788 - RNA, 32 nt, Human
uuauuugucucacacagccauauaguuuuucc

SEQ ID NO: 534789 - RNA, 32 nt, Human
uuauuugugcccagaagcaguuauguaugcuu

SEQ ID NO: 534790 - RNA, 32 nt, Human
uuauuugugcuauucacucccuucccuuugga

SEQ ID NO: 534791 - RNA, 32 nt, Human
uuauuuguggaauuguugcacaugcuccucua

SEQ ID NO: 534792 - RNA, 32 nt, Human
uuauuuguggcagaaggugaucagauaagcuc

SEQ ID NO: 534793 - RNA, 32 nt, Human
uuauuuguuuuuaaguuaggaugcuuuuuaac

SEQ ID NO: 534794 - RNA, 32 nt, Human
uuauuuuaaagaaagaccagaagaguggacaa

SEQ ID NO: 534795 - RNA, 32 nt, Human
uuauuuuaaagugcaagcacaaaauccucaug

SEQ ID NO: 534796 - RNA, 32 nt, Human
uuauuuuaagauccugccauguuuuuaaucac

SEQ ID NO: 534797 - RNA, 32 nt, Human
uuauuuuaauuuuuaauuugaggggaaaagaa

SEQ ID NO: 534798 - RNA, 32 nt, Human
uuauuuuacaaggauguuggcaaacgaaccua

SEQ ID NO: 534799 - RNA, 32 nt, Human
uuauuuuacaguuccagggauugugaaauaaa

SEQ ID NO: 534800 - RNA, 32 nt, Human
uuauuuuacaucuuccaguuuguccaucccau

SEQ ID NO: 534801 - RNA, 32 nt, Human
uuauuuuacugaggaugaucgaagaacuggcu

SEQ ID NO: 534802 - RNA, 32 nt, Human
uuauuuuauaaauacuuuguuuacauuuuaga

SEQ ID NO: 534803 - RNA, 32 nt, Human
uuauuuuauuugccuccagucuggcuaggaaa

SEQ ID NO: 534804 - RNA, 32 nt, Human
uuauuuuauuuuuguagagacaggguuuugcu

SEQ ID NO: 534805 - RNA, 32 nt, Human
uuauuuucaagcaaauauuuaugaccucaaca

SEQ ID NO: 534806 - RNA, 32 nt, Human
uuauuuucaaguagcugggauuuuaaacuaga

SEQ ID NO: 534807 - RNA, 32 nt, Human
uuauuuucaauacuucuuuaaauuuaaaauaa

SEQ ID NO: 534808 - RNA, 32 nt, Human
uuauuuucacugcacacaagacuguauuauga

SEQ ID NO: 534809 - RNA, 32 nt, Human
uuauuuucaugccucccugcuccuaguaaugu

SEQ ID NO: 534810 - RNA, 32 nt, Human
uuauuuucauguuguuauguaaucaauauuuu

SEQ ID NO: 534811 - RNA, 32 nt, Human
uuauuuucauuccguccccuugguacuuugcc

SEQ ID NO: 534812 - RNA, 32 nt, Human
uuauuuucauucuuuauccaugagcaccaggc

SEQ ID NO: 534813 - RNA, 32 nt, Human
uuauuuucccugcaacaucuccaccucccaau

SEQ ID NO: 534814 - RNA, 32 nt, Human
uuauuuuccuauuuuuauuaaauuuggaacca

SEQ ID NO: 534815 - RNA, 32 nt, Human
uuauuuuccuccuccuccuucuucuucuccuu

SEQ ID NO: 534816 - RNA, 32 nt, Human
uuauuuuccuccuccuccuuggccuacucaac

SEQ ID NO: 534817 - RNA, 32 nt, Human
uuauuuuccugaauaagaaccaggaagaaacu

SEQ ID NO: 534818 - RNA, 32 nt, Human
uuauuuuccuuucuaccuucagaaguggcuaa

SEQ ID NO: 534819 - RNA, 32 nt, Human
uuauuuuccuuucuaccuucagaaguggcuau

SEQ ID NO: 534820 - RNA, 32 nt, Human
uuauuuucuaagaucuaccugaacuuagagac

SEQ ID NO: 534821 - RNA, 32 nt, Human
uuauuuucuauuuucuucuguuuccuuuggaa

SEQ ID NO: 534822 - RNA, 32 nt, Human
uuauuuucuccaaauaaaaauuagauggaaaa

SEQ ID NO: 534823 - RNA, 32 nt, Human
uuauuuucucuccuuucagaguuuacauuuuu

SEQ ID NO: 534824 - RNA, 32 nt, Human
uuauuuucuuaaaaucaguagcuauuuggccu

SEQ ID NO: 534825 - RNA, 32 nt, Human
uuauuuucuuccccuaccucucuuccuucuuc

SEQ ID NO: 534826 - RNA, 32 nt, Human
uuauuuucuuucgucugcauguucacaauacc

SEQ ID NO: 534827 - RNA, 32 nt, Human
uuauuuucuuuuucuuucuucauaaagaugag

SEQ ID NO: 534828 - RNA, 32 nt, Human
uuauuuugaacuacuuaccaaaauuagaaguu

SEQ ID NO: 534829 - RNA, 32 nt, Human
uuauuuugaaucccuucuauuuuacuuguaca

SEQ ID NO: 534830 - RNA, 32 nt, Human
uuauuuugaauugcuccaucuccuggugggac

SEQ ID NO: 534831 - RNA, 32 nt, Human
uuauuuugagcucagccccaacucuuuaucaa

SEQ ID NO: 534832 - RNA, 32 nt, Human
uuauuuugaggcagacagagagcuguuauccu

SEQ ID NO: 534833 - RNA, 32 nt, Human
uuauuuugauaguagcuuccuccucugguggu

SEQ ID NO: 534834 - RNA, 32 nt, Human
uuauuuugcauuuaccccaauuuccuuauuug

SEQ ID NO: 534835 - RNA, 32 nt, Human
uuauuuugccauguuuugcaaggcuugguaua

SEQ ID NO: 534836 - RNA, 32 nt, Human
uuauuuugccugaaauuggcuuaaagaaaguc

SEQ ID NO: 534837 - RNA, 32 nt, Human
uuauuuugcuaccucuuugaaaaccugcaugc

SEQ ID NO: 534838 - RNA, 32 nt, Human
uuauuuuggagaagagugaauuuucagcccuc

SEQ ID NO: 534839 - RNA, 32 nt, Human
uuauuuuggauacauuuugaaaagggauagca

SEQ ID NO: 534840 - RNA, 32 nt, Human
uuauuuugucuuuugcaccaguuucuggaggc

SEQ ID NO: 534841 - RNA, 32 nt, Human
uuauuuuguucuguucugucaugugccacaaa

SEQ ID NO: 534842 - RNA, 32 nt, Human
uuauuuuguugauggaauacuguaucauaugc

SEQ ID NO: 534843 - RNA, 32 nt, Human
uuauuuuuaaacauguuagaacuuaccaaaau

SEQ ID NO: 534844 - RNA, 32 nt, Human
uuauuuuuaauaagccucuuccuacuagaaca

SEQ ID NO: 534845 - RNA, 32 nt, Human
uuauuuuuacagugaagacuguuuucagcucu

SEQ ID NO: 534846 - RNA, 32 nt, Human
uuauuuuuacuuuugugaccacuauuuuagaa

SEQ ID NO: 534847 - RNA, 32 nt, Human
uuauuuuuagagaugaggucucacuauguugc

SEQ ID NO: 534848 - RNA, 32 nt, Human
uuauuuuuaggauucaaacagaaagaaaugac

SEQ ID NO: 534849 - RNA, 32 nt, Human
uuauuuuuagggggaaauuuguuuucuuuaug

SEQ ID NO: 534850 - RNA, 32 nt, Human
uuauuuuucaaaugucaccaauaaaaguuuug

SEQ ID NO: 534851 - RNA, 32 nt, Human
uuauuuuucaaggaccucuagacuacagacca

SEQ ID NO: 534852 - RNA, 32 nt, Human
uuauuuuucagaauuugcacauggaacacuua

SEQ ID NO: 534853 - RNA, 32 nt, Human
uuauuuuuccaaguguuuagguaauaauguau

SEQ ID NO: 534854 - RNA, 32 nt, Human
uuauuuuucccuuuucagaaaguccuuagugc

SEQ ID NO: 534855 - RNA, 32 nt, Human
uuauuuuucgagacggagucucgcucugucgc

SEQ ID NO: 534856 - RNA, 32 nt, Human
uuauuuuucucaaaauuuagugaaaaucccuc

SEQ ID NO: 534857 - RNA, 32 nt, Human
uuauuuuucuuuccuuuucucuucuuuauuuu

SEQ ID NO: 534858 - RNA, 32 nt, Human
uuauuuuugcacuucgucaugacaguauagag

SEQ ID NO: 534859 - RNA, 32 nt, Human
uuauuuuugcauaugaaagaggccagaaccca

SEQ ID NO: 534860 - RNA, 22 nt, Human
uuauuuuugcccccaccacccu

SEQ ID NO: 534861 - RNA, 32 nt, Human
uuauuuuugcuagauuuuguauaauguaacaa

SEQ ID NO: 534862 - RNA, 32 nt, Human
uuauuuuugcucucugggaaaauaacaugggc

SEQ ID NO: 534863 - RNA, 32 nt, Human
uuauuuuugcugucuucucuuggcuuauuuuu

SEQ ID NO: 534864 - RNA, 32 nt, Human
uuauuuuuggaauugaaauacuugcuuaaacc

SEQ ID NO: 534865 - RNA, 32 nt, Human
uuauuuuuguaaaugauucugugcccaggagc

SEQ ID NO: 534866 - RNA, 32 nt, Human
uuauuuuugucaaacauguacuccuuucauac

SEQ ID NO: 534867 - RNA, 32 nt, Human
uuauuuuugucuuuccagccagccugcuggcu

SEQ ID NO: 534868 - RNA, 32 nt, Human
uuauuuuuguggcaggcaucugugggaucugu

SEQ ID NO: 534869 - RNA, 25 nt, Human
uucaaaaaaugaaaaaguuuugccu

SEQ ID NO: 534870 - RNA, 32 nt, Human
uucaaaaacaaacaugguaaaaacagccccag

SEQ ID NO: 534871 - RNA, 32 nt, Human
uucaaaaacuccugaaguuuugcuuccccuuc

SEQ ID NO: 534872 - RNA, 32 nt, Human
uucaaaaagcuauucuggggcccuggcccccu

SEQ ID NO: 534873 - RNA, 25 nt, Human
uucaaaaagugaagccacuuuauaa

SEQ ID NO: 534874 - RNA, 32 nt, Human
uucaaaaagugaauuaugucaccauuugcaug

SEQ ID NO: 534875 - RNA, 22 nt, Human
uucaaaaauaaauuugcacugu

SEQ ID NO: 534876 - RNA, 21 nt, Human
uucaaaaaugcucugcacugu

SEQ ID NO: 534877 - RNA, 32 nt, Human
uucaaaacauuggcaguaguuguugaaaaaga

SEQ ID NO: 534878 - RNA, 32 nt, Human
uucaaaaccaaccuggucuacauggugaaacc

SEQ ID NO: 534879 - RNA, 32 nt, Human
uucaaaaccagccugaccaacauggugaaacc

SEQ ID NO: 534880 - RNA, 32 nt, Human
uucaaaaccagccugaccaauauggugaaacc

SEQ ID NO: 534881 - RNA, 24 nt, Human
uucaaaaccagccuggacaacaug

SEQ ID NO: 534882 - RNA, 32 nt, Human
uucaaaaccagccuggacaaucuggcgaaacc

SEQ ID NO: 534883 - RNA, 24 nt, Human
uucaaaaccagccuggccaacaua

SEQ ID NO: 534884 - RNA, 32 nt, Human
uucaaaaccagccuggccaacauagugaaacc

SEQ ID NO: 534885 - RNA, 24 nt, Human
uucaaaaccagccuggccaacaug

SEQ ID NO: 534886 - RNA, 32 nt, Human
uucaaaaccagccuggccaacaugcaaaaccc

SEQ ID NO: 534887 - RNA, 32 nt, Human
uucaaaaccagccuggccaacaugcugaaacc

SEQ ID NO: 534888 - RNA, 32 nt, Human
uucaaaaccagccuggccaacauggugaaacc

SEQ ID NO: 534889 - RNA, 24 nt, Human
uucaaaaccagccugggcaacaua

SEQ ID NO: 534890 - RNA, 32 nt, Human
uucaaaaccagccugggcaacauagcaagacc

SEQ ID NO: 534891 - RNA, 32 nt, Human
uucaaaaccagccugggcaauauagugagacc

SEQ ID NO: 534892 - RNA, 27 nt, Human
uucaaaaccagccuguccaauauagug

SEQ ID NO: 534893 - RNA, 24 nt, Human
uucaaaaccagcuugggcagcaug

SEQ ID NO: 534894 - RNA, 24 nt, Human
uucaaaaccaggcugggcaacaua

SEQ ID NO: 534895 - RNA, 22 nt, Human
uucaaaacgcagguguuucugg

SEQ ID NO: 534896 - RNA, 32 nt, Human
uucaaaacucagaugcauaaaacguaagguau

SEQ ID NO: 534897 - RNA, 32 nt, Human
uucaaaacucugucaagaacuccgucugcuug

SEQ ID NO: 534898 - RNA, 19 nt, Human
uucaaaagaaaacauaaga

SEQ ID NO: 534899 - RNA, 32 nt, Human
uucaaaagaaaauguuuauuuguucucauuaa

SEQ ID NO: 534900 - RNA, 32 nt, Human
uucaaaagaacagcaagcucugcaguaaaccu

SEQ ID NO: 534901 - RNA, 32 nt, Human
uucaaaagaaccacacuagggucuccaccuac

SEQ ID NO: 534902 - RNA, 32 nt, Human
uucaaaagacaggcaagcucacuacuagaaca

SEQ ID NO: 534903 - RNA, 32 nt, Human
uucaaaagcacuuugugcuguguucuauauaa

SEQ ID NO: 534904 - RNA, 21 nt, Human
uucaaaagcuaaucugccugu

SEQ ID NO: 534905 - RNA, 32 nt, Human
uucaaaaggagaggagaaaggaaaugagaaug

SEQ ID NO: 534906 - RNA, 32 nt, Human
uucaaaaggauggggaagugcgaucuuggcau

SEQ ID NO: 534907 - RNA, 32 nt, Human
uucaaaagggagcaaugcugugaaugcagcuu

SEQ ID NO: 534908 - RNA, 32 nt, Human
uucaaaagguguagaccuccugacugaagcau

SEQ ID NO: 534909 - RNA, 32 nt, Human
uucaaaaguaguucagcuuucauaaguagaac

SEQ ID NO: 534910 - RNA, 32 nt, Human
uucaaaagucucugugcaguggaagcaaaacu

SEQ ID NO: 534911 - RNA, 32 nt, Human
uucaaaagugaaggaaggaggccaggcgccgu

SEQ ID NO: 534912 - RNA, 22 nt, Human
uucaaaauaaguguauaaaaug

SEQ ID NO: 534913 - RNA, 32 nt, Human
uucaaaauauaaauuuguuuugauucuuuaua

SEQ ID NO: 534914 - RNA, 32 nt, Human
uucaaaaucaacaacagauugucucucggcuc

SEQ ID NO: 534915 - RNA, 32 nt, Human
uucaaaaucagccuggccaaaaugcugaaacu

SEQ ID NO: 534916 - RNA, 32 nt, Human
uucaaaaucagccugggguauauagcgagacg

SEQ ID NO: 534917 - RNA, 32 nt, Human
uucaaaaugaagauacacauuacagccaggug

SEQ ID NO: 534918 - RNA, 20 nt, Human
uucaaaaugcagcaaacuuu

SEQ ID NO: 534919 - RNA, 32 nt, Human
uucaaaauguuaggcugggggccguggccagc

SEQ ID NO: 534920 - RNA, 32 nt, Human
uucaaaauuagccuggugugguggcgcaugcc

SEQ ID NO: 534921 - RNA, 32 nt, Human
uucaaacaaaggaggaggagucauagggaaga

SEQ ID NO: 534922 - RNA, 22 nt, Human
uucaaacaauucuccugccuca

SEQ ID NO: 534923 - RNA, 32 nt, Human
uucaaacacagaaugccaagcuucagguugaa

SEQ ID NO: 534924 - RNA, 32 nt, Human
uucaaacauaugcauuauaugucaaaguaugc

SEQ ID NO: 534925 - RNA, 32 nt, Human
uucaaacaugaaggagaaauaaacuuucccag

SEQ ID NO: 534926 - RNA, 32 nt, Human
uucaaacaugccauaaggaaaacgagugccug

SEQ ID NO: 534927 - RNA, 32 nt, Human
uucaaaccagacgggccaacauggugaaaccc

SEQ ID NO: 534928 - RNA, 32 nt, Human
uucaaacccaacugugcugcuaacccacccug

SEQ ID NO: 534929 - RNA, 32 nt, Human
uucaaacccacugcuggcacaucccuuuccuu

SEQ ID NO: 534930 - RNA, 32 nt, Human
uucaaaccucacaagaugaaacucagaagaga

SEQ ID NO: 534931 - RNA, 32 nt, Human
uucaaaccuggugcauucaucccuggagcgcc

SEQ ID NO: 534932 - RNA, 32 nt, Human
uucaaacgagggucccgaaccccggggcggca

SEQ ID NO: 534933 - RNA, 22 nt, Human
uucaaacgcauccauggaguca

SEQ ID NO: 534934 - RNA, 31 nt, Human
uucaaacguuacuucaucugccaaagcauua

SEQ ID NO: 534935 - RNA, 32 nt, Human
uucaaacuauugcccauguuccccagggucag

SEQ ID NO: 534936 - RNA, 32 nt, Human
uucaaacucuaagaguacagagguuaguaaga

SEQ ID NO: 534937 - RNA, 32 nt, Human
uucaaacugagguggaaugcagugguucccau

SEQ ID NO: 534938 - RNA, 19 nt, Human
uucaaacugaguaaauugg

SEQ ID NO: 534939 - RNA, 32 nt, Human
uucaaacugccuauauugauaaaaccauacag

SEQ ID NO: 534940 - RNA, 21 nt, Human
uucaaacugcuaaauuaggua

SEQ ID NO: 534941 - RNA, 32 nt, Human
uucaaacuuccguaauggaguuagcccacagu

SEQ ID NO: 534942 - RNA, 32 nt, Human
uucaaacuugcucugcagcuaaggaaggugag

SEQ ID NO: 534943 - RNA, 32 nt, Human
uucaaagaaacaauguguauugaaguaccuag

SEQ ID NO: 534944 - RNA, 32 nt, Human
uucaaagaaauagguucacaacaggaauauac

SEQ ID NO: 534945 - RNA, 32 nt, Human
uucaaagaacuccggggaaacugggauagaac

SEQ ID NO: 534946 - RNA, 32 nt, Human
uucaaagaagcaggagaucuuuuauacagcca

SEQ ID NO: 534947 - RNA, 32 nt, Human
uucaaagaagugaggaugcaguuucucacguu

SEQ ID NO: 534948 - RNA, 32 nt, Human
uucaaagacagagaagaccaaagcauugccug

SEQ ID NO: 534949 - RNA, 32 nt, Human
uucaaagacagagagccaugagacuuucccaa

SEQ ID NO: 534950 - RNA, 32 nt, Human
uucaaagacccacagcuugagggggcagaggg

SEQ ID NO: 534951 - RNA, 32 nt, Human
uucaaagacgaggaaguaaggaagggaaugca

SEQ ID NO: 534952 - RNA, 32 nt, Human
uucaaagacuaguacuuacacaguuuagaaga

SEQ ID NO: 534953 - RNA, 21 nt, Human
uucaaagacugugcuacggga

SEQ ID NO: 534954 - RNA, 32 nt, Human
uucaaagagaagcaggagggcaagggaaaguu

SEQ ID NO: 534955 - RNA, 32 nt, Human
uucaaagagacaaacuccauuuucuuaugaau

SEQ ID NO: 534956 - RNA, 32 nt, Human
uucaaagagacuaugauggaccagcccugaga

SEQ ID NO: 534957 - RNA, 32 nt, Human
uucaaagagcacguaucuagaccugcuggacu

SEQ ID NO: 534958 - RNA, 32 nt, Human
uucaaagagcaucuccacaacccacagccuuc

SEQ ID NO: 534959 - RNA, 32 nt, Human
uucaaagaguuugucuacaggcgguuucucug

SEQ ID NO: 534960 - RNA, 32 nt, Human
uucaaagauguggucauuuacuucucucaaaa

SEQ ID NO: 534961 - RNA, 32 nt, Human
uucaaagauuaaguaggaggagagggguuucu

SEQ ID NO: 534962 - RNA, 32 nt, Human
uucaaagauucagagauuggcuuuugucaucc

SEQ ID NO: 534963 - RNA, 32 nt, Human
uucaaagauucugcaagucagacuggccucug

SEQ ID NO: 534964 - RNA, 32 nt, Human
uucaaagcaaacccuuacacacacaaagcccc

SEQ ID NO: 534965 - RNA, 32 nt, Human
uucaaagcaaaugaagugccuuuucccgaggc

SEQ ID NO: 534966 - RNA, 32 nt, Human
uucaaagcaaaugucuuccuggauuauucaaa

SEQ ID NO: 534967 - RNA, 32 nt, Human
uucaaagcaacaccaccaccacugaaguauuu

SEQ ID NO: 534968 - RNA, 32 nt, Human
uucaaagcaguagagaaaaauguaagauagga

SEQ ID NO: 534969 - RNA, 32 nt, Human
uucaaagccacugaggggaggaagggcagggc

SEQ ID NO: 534970 - RNA, 19 nt, Human
uucaaagccagaaauaaga

SEQ ID NO: 534971 - RNA, 32 nt, Human
uucaaagccagccugagccacauagugagacu

SEQ ID NO: 534972 - RNA, 32 nt, Human
uucaaagcccagcucaagcuucaucuuccuca

SEQ ID NO: 534973 - RNA, 32 nt, Human
uucaaagccucauuugcuuaucuugcuggagc

SEQ ID NO: 534974 - RNA, 32 nt, Human
uucaaagcuccauuucauaaaggggcuacuuu

SEQ ID NO: 534975 - RNA, 22 nt, Human
uucaaagcuccuucugcauugu

SEQ ID NO: 534976 - RNA, 32 nt, Human
uucaaagcucgaaaucaaauagcugcuggauu

SEQ ID NO: 534977 - RNA, 32 nt, Human
uucaaagcugcuccaccaugcugggucccagg

SEQ ID NO: 534978 - RNA, 32 nt, Human
uucaaagcuggguuagagaugaggcaccuuuu

SEQ ID NO: 534979 - RNA, 32 nt, Human
uucaaagcuuugaccugcacaaaugccauauu

SEQ ID NO: 534980 - RNA, 32 nt, Human
uucaaaggaaaugucuacaaugugaguuaaua

SEQ ID NO: 534981 - RNA, 19 nt, Human
uucaaaggaaugugccaug

SEQ ID NO: 534982 - RNA, 32 nt, Human
uucaaaggacaguguuguuuugaccgggagau

SEQ ID NO: 534983 - RNA, 32 nt, Human
uucaaaggagaggagagaagagacugagucgc

SEQ ID NO: 534984 - RNA, 32 nt, Human
uucaaaggcuaugaaauaguaaccucaagcca

SEQ ID NO: 534985 - RNA, 32 nt, Human
uucaaaggcugaggcaggcagaucaccugagg

SEQ ID NO: 534986 - RNA, 32 nt, Human
uucaaagggaaaggaagaggcaaagaggagca

SEQ ID NO: 534987 - RNA, 32 nt, Human
uucaaagggaaguguggucagcacacacugag

SEQ ID NO: 534988 - RNA, 32 nt, Human
uucaaagggaggacuugcuggggaccagaauc

SEQ ID NO: 534989 - RNA, 32 nt, Human
uucaaagucagcugaggggcugaggggugggg

SEQ ID NO: 534990 - RNA, 32 nt, Human
uucaaagucuguuucuugagcccugacugugu

SEQ ID NO: 534991 - RNA, 32 nt, Human
uucaaaguguauucaaguagguuuucugaaau

SEQ ID NO: 534992 - RNA, 32 nt, Human
uucaaaguguguggugccuccccucugucucc

SEQ ID NO: 534993 - RNA, 32 nt, Human
uucaaaguucuggacccagccauuccaguaga

SEQ ID NO: 534994 - RNA, 32 nt, Human
uucaaauaaccagacaccaagaugcagggccc

SEQ ID NO: 534995 - RNA, 32 nt, Human
uucaaauaacccagugacauaggucauauugc

SEQ ID NO: 534996 - RNA, 32 nt, Human
uucaaauaacccuugaauucaccaggucucau

SEQ ID NO: 534997 - RNA, 22 nt, Human
uucaaauaauagcauucauaug

SEQ ID NO: 534998 - RNA, 20 nt, Human
uucaaauagcaugauccaug

SEQ ID NO: 534999 - RNA, 32 nt, Human
uucaaauaucaaaaggaagauucuuccauuaa

SEQ ID NO: 535000 - RNA, 32 nt, Human
uucaaaucaaagcuaaaagccuaaaugugaaa

SEQ ID NO: 535001 - RNA, 32 nt, Human
uucaaaucaaauuagaauucacugagaauaau

SEQ ID NO: 535002 - RNA, 22 nt, Human
uucaaauccagauaguauuaca

SEQ ID NO: 535003 - RNA, 32 nt, Human
uucaaauccauagauuucgaagccacagaguc

SEQ ID NO: 535004 - RNA, 32 nt, Human
uucaaauccuaaaucacuucuuguaggagggu

SEQ ID NO: 535005 - RNA, 32 nt, Human
uucaaauccugcacucaggccugguggugaag

SEQ ID NO: 535006 - RNA, 32 nt, Human
uucaaaucucuccuccucccccucucuccuuc

SEQ ID NO: 535007 - RNA, 32 nt, Human
uucaaaucuuuccuccccauuugugagcugug

SEQ ID NO: 535008 - RNA, 32 nt, Human
uucaaaugaaaccagaaggugguuauguaaga

SEQ ID NO: 535009 - RNA, 32 nt, Human
uucaaaugaaguuucaguugcugaaaaccaau

SEQ ID NO: 535010 - RNA, 32 nt, Human
uucaaaugccuuucaaacauccuuugagauga

SEQ ID NO: 535011 - RNA, 32 nt, Human
uucaaaugcugugcagccaucuugccucaacu

SEQ ID NO: 535012 - RNA, 32 nt, Human
uucaaauggccauuuuucuccaauuuugguaa

SEQ ID NO: 535013 - RNA, 32 nt, Human
uucaaauggcugcuuaaaauugccugcaaaug

SEQ ID NO: 535014 - RNA, 32 nt, Human
uucaaauggggcuguuucuggaaaaaugaaaa

SEQ ID NO: 535015 - RNA, 32 nt, Human
uucaaauguauaugguucuggccacauuaaag

SEQ ID NO: 535016 - RNA, 32 nt, Human
uucaaauguauuacuaauguccuuccaaacag

SEQ ID NO: 535017 - RNA, 32 nt, Human
uucaaauguggacaaauuuuggaaaguauuuu

SEQ ID NO: 535018 - RNA, 32 nt, Human
uucaaauuagauguuucaacugugcuccuguu

SEQ ID NO: 535019 - RNA, 32 nt, Human
uucaaauuauuuagaagcagauuuuccuguag

SEQ ID NO: 535020 - RNA, 32 nt, Human
uucaaauucagggcauccaacauggugaagcc

SEQ ID NO: 535021 - RNA, 32 nt, Human
uucaaauuccaaaccuaccaucuucaguugug

SEQ ID NO: 535022 - RNA, 32 nt, Human
uucaaauuccaugacauuggaaaaaggucauc

SEQ ID NO: 535023 - RNA, 32 nt, Human
uucaaauucccaggaguagaccagcaucucug

SEQ ID NO: 535024 - RNA, 32 nt, Human
uucaaauugagauuguugccacugugguuugc

SEQ ID NO: 535025 - RNA, 32 nt, Human
uucaaauuuacaaggguucauuuuggaaacua

SEQ ID NO: 535026 - RNA, 32 nt, Human
uucaaauuugucagugacauuuaccaaacaaa

SEQ ID NO: 535027 - RNA, 32 nt, Human
uucaaauuuuggugucuguuaauaaaguuuua

SEQ ID NO: 535028 - RNA, 32 nt, Human
uucaacaaaguauuggaaguccuggucagagc

SEQ ID NO: 535029 - RNA, 32 nt, Human
uucaacaacagugacuugcucuccaaugguau

SEQ ID NO: 535030 - RNA, 32 nt, Human
uucaacaacucuccagcucugaauggagaaac

SEQ ID NO: 535031 - RNA, 32 nt, Human
uuccagaaagucuuugagggaggaccuauacc

SEQ ID NO: 535032 - RNA, 32 nt, Human
uuccagaaaugagaguggcaucuuuauggaau

SEQ ID NO: 535033 - RNA, 32 nt, Human
uuccagaaaugccacacuugugugccacagag

SEQ ID NO: 535034 - RNA, 32 nt, Human
uuccagaacaacucuuucccaccccaacacca

SEQ ID NO: 535035 - RNA, 32 nt, Human
uuccagaacacugcuacuagguucugaauguu

SEQ ID NO: 535036 - RNA, 32 nt, Human
uuccagaaccuuuuaugucucucgugagccau

SEQ ID NO: 535037 - RNA, 32 nt, Human
uuccagaacgccgccucccacccagaucgcgg

SEQ ID NO: 535038 - RNA, 32 nt, Human
uuccagaacucaugccagauacuuaguccagu

SEQ ID NO: 535039 - RNA, 32 nt, Human
uuccagaagaaagauggaaauucugaaaacug

SEQ ID NO: 535040 - RNA, 32 nt, Human
uuccagaagagacucgggcuguggaaggaaca

SEQ ID NO: 535041 - RNA, 32 nt, Human
uuccagaagauaagacagacucauagagauua

SEQ ID NO: 535042 - RNA, 32 nt, Human
uuccagaagcaggaguccccagagccaggcag

SEQ ID NO: 535043 - RNA, 32 nt, Human
uuccagaagugaugcaguggugugagaugccc

SEQ ID NO: 535044 - RNA, 32 nt, Human
uuccagaaugccuagaggaaggggguuccuuu

SEQ ID NO: 535045 - RNA, 32 nt, Human
uuccagaaugguauggaaucugagggaagauu

SEQ ID NO: 535046 - RNA, 32 nt, Human
uuccagacacagacaugcuggcagugagagug

SEQ ID NO: 535047 - RNA, 32 nt, Human
uuccagacacuccugaauuuacuuggauuuaa

SEQ ID NO: 535048 - RNA, 32 nt, Human
uuccagaccaaccuggccaacaugguaaaacc

SEQ ID NO: 535049 - RNA, 32 nt, Human
uuccagaccacccuggccaacauggugaaacc

SEQ ID NO: 535050 - RNA, 32 nt, Human
uuccagaccagccccucacaccacagccaaga

SEQ ID NO: 535051 - RNA, 32 nt, Human
uuccagaccagccccucacaccacagccagga

SEQ ID NO: 535052 - RNA, 32 nt, Human
uuccagaccagccccucacaccaccgccagga

SEQ ID NO: 535053 - RNA, 32 nt, Human
uuccagaccagcccgggccuauggcgaaacuc

SEQ ID NO: 535054 - RNA, 32 nt, Human
uuccagaccagccuaggcagcuuggcaagacc

SEQ ID NO: 535055 - RNA, 32 nt, Human
uuccagaccagccugaccaaaauggugaaacc

SEQ ID NO: 535056 - RNA, 32 nt, Human
uuccagaccagccugaccaacguggugaaacu

SEQ ID NO: 535057 - RNA, 24 nt, Human
uuccagaccagccuggccaacaua

SEQ ID NO: 535058 - RNA, 32 nt, Human
uuccagaccagccuggccaacauagugaaacc

SEQ ID NO: 535059 - RNA, 24 nt, Human
uuccagaccagccuggccaacaug

SEQ ID NO: 535060 - RNA, 32 nt, Human
uuccagaccagccuggccaacaugaugaaacc

SEQ ID NO: 535061 - RNA, 32 nt, Human
uuccagaccagccuggccaacauggcaaaacc

SEQ ID NO: 535062 - RNA, 32 nt, Human
uuccagaccagccuggccaacauggcuuucuu

SEQ ID NO: 535063 - RNA, 32 nt, Human
uuccagaccagccuggccaacauggugaaacc

SEQ ID NO: 535064 - RNA, 32 nt, Human
uuccagaccagccuggccaacauggugaaacu

SEQ ID NO: 535065 - RNA, 32 nt, Human
uuccagaccagccuggccaccuuagugagauc

SEQ ID NO: 535066 - RNA, 32 nt, Human
uuccagaccagccuggccaucauggugaaauc

SEQ ID NO: 535067 - RNA, 24 nt, Human
uuccagaccagccuggcuaauaug

SEQ ID NO: 535068 - RNA, 32 nt, Human
uuccagaccagccuggcuaauauggugaaacc

SEQ ID NO: 535069 - RNA, 32 nt, Human
uuccagaccagccugggaaacgcaaagcgacc

SEQ ID NO: 535070 - RNA, 24 nt, Human
uuccagaccagccugggcaacaua

SEQ ID NO: 535071 - RNA, 32 nt, Human
uuccagaccagccugggcaacauagcaaaauc

SEQ ID NO: 535072 - RNA, 32 nt, Human
uuccagaccagccugggcaacauagugagacu

SEQ ID NO: 535073 - RNA, 32 nt, Human
uuccagaccagccugggcaacauagugagauc

SEQ ID NO: 535074 - RNA, 24 nt, Human
uuccagaccagccugggcaacaug

SEQ ID NO: 535075 - RNA, 32 nt, Human
uuccagaccagccugggcaacaugcgagaccc

SEQ ID NO: 535076 - RNA, 22 nt, Human
uuccagaccagccugggcaaua

SEQ ID NO: 535077 - RNA, 32 nt, Human
uuccagaccagccugggcaauacagcgagaac

SEQ ID NO: 535078 - RNA, 24 nt, Human
uuccagaccagccugggcaauaua

SEQ ID NO: 535079 - RNA, 24 nt, Human
uuccagaccagccugggcaaugua

SEQ ID NO: 535080 - RNA, 32 nt, Human
uuccagaccagccugggcaauguagcaagacg

SEQ ID NO: 535081 - RNA, 32 nt, Human
uuccagaccagccugggcagcaucgugagacc

SEQ ID NO: 535082 - RNA, 24 nt, Human
uuccagaccagccuggguaaugua

SEQ ID NO: 535083 - RNA, 32 nt, Human
uuccagaccagccuggguaauguagcgagacc

SEQ ID NO: 535084 - RNA, 24 nt, Human
uuccagaccagccuggucaacaug

SEQ ID NO: 535085 - RNA, 32 nt, Human
uuccagaccagccuggucaacauggugaaacc

SEQ ID NO: 535086 - RNA, 32 nt, Human
uuccagaccagccuguucaacauggcgaaacc

SEQ ID NO: 535087 - RNA, 32 nt, Human
uuccagaccaggcuggccgacauggugaaacc

SEQ ID NO: 535088 - RNA, 24 nt, Human
uuccagaccagugugggcaacgua

SEQ ID NO: 535089 - RNA, 32 nt, Human
uuccagaccauuccaggcagggagagcugcug

SEQ ID NO: 535090 - RNA, 32 nt, Human
uuccagaccccacaguagagcacuuuucacuu

SEQ ID NO: 535091 - RNA, 23 nt, Human
uuccagaccgccugggcaacaug

SEQ ID NO: 535092 - RNA, 32 nt, Human
uuccagaccuggguuugugcagcuccaagcuc

SEQ ID NO: 535093 - RNA, 32 nt, Human
uuccagacuagccugggcaacauagagagacc

SEQ ID NO: 535094 - RNA, 32 nt, Human
uuccagacuuaagaauuuuauggcauggccca

SEQ ID NO: 535095 - RNA, 32 nt, Human
uuccagagacaauuguagaaauauugcugcau

SEQ ID NO: 535096 - RNA, 32 nt, Human
uuccagagagaagagaaaacucacccaggaag

SEQ ID NO: 535097 - RNA, 32 nt, Human
uuccagagagggcagggcaauggcagugacau

SEQ ID NO: 535098 - RNA, 32 nt, Human
uuccagagauggaguuucaccacguuggccaa

SEQ ID NO: 535099 - RNA, 32 nt, Human
uuccagagcagccugggcaacgcagugagaga

SEQ ID NO: 535100 - RNA, 32 nt, Human
uuccagagccacaggcccuggauuuuauccaa

SEQ ID NO: 535101 - RNA, 32 nt, Human
uuccagagccuucucuucacauaaugggacau

SEQ ID NO: 535102 - RNA, 32 nt, Human
uuccagagcuuugugcucaggcuacuaaagua

SEQ ID NO: 535103 - RNA, 31 nt, Human
uuccagaggaaaccuguuugacuugauagau

SEQ ID NO: 535104 - RNA, 32 nt, Human
uuccagaggaaaccuguuugacuugauagaug

SEQ ID NO: 535105 - RNA, 32 nt, Human
uuccagaggaagaagcaggcagcaaccuuugc

SEQ ID NO: 535106 - RNA, 32 nt, Human
uuccagaggaagacacagcuuaguagcuuaag

SEQ ID NO: 535107 - RNA, 32 nt, Human
uuccagaggaagaggaggaggcggcgaagcgu

SEQ ID NO: 535108 - RNA, 32 nt, Human
uuccagaggaaggaauacacagcaaucuuugc

SEQ ID NO: 535109 - RNA, 22 nt, Human
uuccagaggcaaauacuuuuca

SEQ ID NO: 535110 - RNA, 32 nt, Human
uuccagaggcugggaacacggcccaccuagca

SEQ ID NO: 535111 - RNA, 21 nt, Human
uuccagagggaggugcuguua

SEQ ID NO: 535112 - RNA, 32 nt, Human
uuccagagggauggggcagagcuccaggccuc

SEQ ID NO: 535113 - RNA, 32 nt, Human
uuccagagggucucgcucuccuucccuuuuuc

SEQ ID NO: 535114 - RNA, 32 nt, Human
uuccagagguaaaccaggucucagggaagagc

SEQ ID NO: 535115 - RNA, 32 nt, Human
uuccagagguuagaaaacuugcuugaaguucc

SEQ ID NO: 535116 - RNA, 32 nt, Human
uuccagagugcuuacagaaggccaggugcuuu

SEQ ID NO: 535117 - RNA, 19 nt, Human
uuccagaucagcagggaga

SEQ ID NO: 535118 - RNA, 32 nt, Human
uuccagaucagcaugggcaacaugguaagacc

SEQ ID NO: 535119 - RNA, 24 nt, Human
uuccagaucagccugagcaacaua

SEQ ID NO: 535120 - RNA, 32 nt, Human
uuccagaucagccugagcaacauagcaagaug

SEQ ID NO: 535121 - RNA, 24 nt, Human
uuccagaucagccuggccaacaug

SEQ ID NO: 535122 - RNA, 32 nt, Human
uuccagaucagccuggccaacauggugaaacc

SEQ ID NO: 535123 - RNA, 31 nt, Human
uuccagauccucucuggggcuguguuuugag

SEQ ID NO: 535124 - RNA, 32 nt, Human
uuccagaucgcuggccccagaacccugucccc

SEQ ID NO: 535125 - RNA, 31 nt, Human
uuccagaugcuucugacuaagaucccaacaa

SEQ ID NO: 535126 - RNA, 32 nt, Human
uuccagauggagucucgcuuuguugcccaggc

SEQ ID NO: 535127 - RNA, 32 nt, Human
uuccagauggcgaggucacagcagagagaugu

SEQ ID NO: 535128 - RNA, 32 nt, Human
uuccagaugggaacuggugcaagcugcuuugc

SEQ ID NO: 535129 - RNA, 32 nt, Human
uuccagaugguccaggccuccuuugugcauga

SEQ ID NO: 535130 - RNA, 32 nt, Human
uuccagauuacacuccagccugagucagcacc

SEQ ID NO: 535131 - RNA, 23 nt, Human
uuccagauucccagauuuugugc

SEQ ID NO: 535132 - RNA, 32 nt, Human
uuccagauucuguguuccucccuucccugccc

SEQ ID NO: 535133 - RNA, 32 nt, Human
uuccagauuguuuccagcuguaacagguauug

SEQ ID NO: 535134 - RNA, 32 nt, Human
uuccagcaacaaucauuuauuguuaaaccugg

SEQ ID NO: 535135 - RNA, 32 nt, Human
uuccagcaacccagucuccugccauguccgac

SEQ ID NO: 535136 - RNA, 32 nt, Human
uuccagcacccagccggcccuccgucuccuga

SEQ ID NO: 535137 - RNA, 32 nt, Human
uuccagcacuuccggccugaccccuguccagc

SEQ ID NO: 535138 - RNA, 23 nt, Human
uuccagcacuuucugucauucca

SEQ ID NO: 535139 - RNA, 32 nt, Human
uuccagcagcagacccagcaaugaaugauccg

SEQ ID NO: 535140 - RNA, 21 nt, Human
uuccagcagcuccugcccccu

SEQ ID NO: 535141 - RNA, 32 nt, Human
uuccagcaguuugcucuugagacaugguaauc

SEQ ID NO: 535142 - RNA, 32 nt, Human
uuccagcaucugcugguagcaggcugggacag

SEQ ID NO: 535143 - RNA, 32 nt, Human
uuccagcaugauguucuugucuuuggagcuua

SEQ ID NO: 535144 - RNA, 21 nt, Human
uuccagcaugucgccaacgca

SEQ ID NO: 535145 - RNA, 32 nt, Human
uuccagccaaacaggggagcccagggagaaua

SEQ ID NO: 535146 - RNA, 32 nt, Human
uuccagccaagaaaauagacugaggugcuuau

SEQ ID NO: 535147 - RNA, 32 nt, Human
uuccagccacaucgccugagauugacaacgcc

SEQ ID NO: 535148 - RNA, 22 nt, Human
uuccagccacucaggaggcuga

SEQ ID NO: 535149 - RNA, 22 nt, Human
uuccagccacucgagaggcuga

SEQ ID NO: 535150 - RNA, 32 nt, Human
uuccagccauguccaguaaacaauuuagagca

SEQ ID NO: 535151 - RNA, 32 nt, Human
uuccagcccaggaguucaagaccagccugggc

SEQ ID NO: 535152 - RNA, 22 nt, Human
uuccagcccuccuaauaccuca

SEQ ID NO: 535153 - RNA, 32 nt, Human
uuccagcccugcugcuugccagacacacagaa

SEQ ID NO: 535154 - RNA, 32 nt, Human
uuccagccggcauggcugggaacugcagaccu

SEQ ID NO: 535155 - RNA, 18 nt, Human
uuccagccgguggcacag

SEQ ID NO: 535156 - RNA, 20 nt, Human
uuccagccuaggcaacagag

SEQ ID NO: 535157 - RNA, 21 nt, Human
uuccagccuaggcaacagagu

SEQ ID NO: 535158 - RNA, 21 nt, Human
uuccagccuaggcgacagagu

SEQ ID NO: 535159 - RNA, 32 nt, Human
uuccagccucaggucccagcugucucacguug

SEQ ID NO: 535160 - RNA, 32 nt, Human
uuccagccuccaccuacugcccaauuccagag

SEQ ID NO: 535161 - RNA, 32 nt, Human
uuccagccuccccucaggcuuuccagucacca

SEQ ID NO: 535162 - RNA, 21 nt, Human
uuccagccucugccccucagg

SEQ ID NO: 535163 - RNA, 20 nt, Human
uuccagccugagcaacagag

SEQ ID NO: 535164 - RNA, 21 nt, Human
uuccagccugagcgacagagu

SEQ ID NO: 535165 - RNA, 32 nt, Human
uuccagccugcucugcucgcgugccuuucugu

SEQ ID NO: 535166 - RNA, 32 nt, Human
uuccagccuggcgacagagcaagacuccaucu

SEQ ID NO: 535167 - RNA, 20 nt, Human
uuccagccugggcaacagag

SEQ ID NO: 535168 - RNA, 21 nt, Human
uuccagccugggcaacagagu

SEQ ID NO: 535169 - RNA, 21 nt, Human
uuccagccugggcaauagagu

SEQ ID NO: 535170 - RNA, 20 nt, Human
uuccagccugggcgacagag

SEQ ID NO: 535171 - RNA, 21 nt, Human
uuccagccugggcgacagagu

SEQ ID NO: 535172 - RNA, 25 nt, Human
uuccagccugggugacagagcgaga

SEQ ID NO: 535173 - RNA, 25 nt, Human
uuccagccugggugacagagugaga

SEQ ID NO: 535174 - RNA, 32 nt, Human
uuccagccuggugacagagcgagacucagucu

SEQ ID NO: 535175 - RNA, 32 nt, Human
uuccagccuuaagaguuguggaagagaagaaa

SEQ ID NO: 535176 - RNA, 32 nt, Human
uuccagccuugugaaggaacugguuuuguuuu

SEQ ID NO: 535177 - RNA, 32 nt, Human
uuccagccuuucuagccugcccucugcugcca

SEQ ID NO: 535178 - RNA, 32 nt, Human
uuccagcgagacgucagagaacucacagucuu

SEQ ID NO: 535179 - RNA, 23 nt, Human
uuccagcgcaggcugcugcucgu

SEQ ID NO: 535180 - RNA, 32 nt, Human
uuccagcggcaggcugugcaccagaggucccg

SEQ ID NO: 535181 - RNA, 32 nt, Human
uuccagcggugccacccaaucaugcccagcuu

SEQ ID NO: 535182 - RNA, 32 nt, Human
uuccagcgucaagcucucugggcagcugcugg

SEQ ID NO: 535183 - RNA, 32 nt, Human
uuccagcgucauuucaaagagcuauuguuuuu

SEQ ID NO: 535184 - RNA, 22 nt, Human
uuccagcuacccaggaggcuga

SEQ ID NO: 535185 - RNA, 22 nt, Human
uuccagcuacucaggaggcuga

SEQ ID NO: 535186 - RNA, 22 nt, Human
uuccagcuacucgggaggccga

SEQ ID NO: 535187 - RNA, 20 nt, Human
uuccagcuacucgggaggcu

SEQ ID NO: 535188 - RNA, 22 nt, Human
uuccagcuacucgggaggcuga

SEQ ID NO: 535189 - RNA, 32 nt, Human
uuccagcuacuugggagguugaggcaggagaa

SEQ ID NO: 535190 - RNA, 24 nt, Human
uuccagcuagauguugucauugca

SEQ ID NO: 535191 - RNA, 32 nt, Human
uuccagcuaggacacagcaggucgugauccgg

SEQ ID NO: 535192 - RNA, 32 nt, Human
uuccagcucacugcgcagccugggaggaggcg

SEQ ID NO: 535193 - RNA, 32 nt, Human
uuccagcucagagcuccucccaccccaacaua

SEQ ID NO: 535194 - RNA, 32 nt, Human
uuccagcuccaaggacugggaaccuccaaugc

SEQ ID NO: 535195 - RNA, 32 nt, Human
uuccagcuccaccuccacuaccacuccaagcc

SEQ ID NO: 535196 - RNA, 32 nt, Human
uuccagcucccgguaaaacacaauuuauuucu

SEQ ID NO: 535197 - RNA, 32 nt, Human
uuccagcuccuccuccugacugaccgcuggca

SEQ ID NO: 535198 - RNA, 32 nt, Human
uuccagcuccuugguguugguuugcaauaaau

SEQ ID NO: 535199 - RNA, 32 nt, Human
uuccagcucuuaaaauucuuuaucuuuuucuu

SEQ ID NO: 535200 - RNA, 23 nt, Human
uuccagcugcaugggaaagcaaa

SEQ ID NO: 535201 - RNA, 32 nt, Human
uuccagcugccucucauguacuugucuguugg

SEQ ID NO: 535202 - RNA, 16 nt, Human
uuccagcugccugcca

SEQ ID NO: 535203 - RNA, 32 nt, Human
uuccagcugcuugggagccugaggcaggagaa

SEQ ID NO: 535204 - RNA, 32 nt, Human
uuccagcugcuugucuggccugagcugugggg

SEQ ID NO: 535205 - RNA, 32 nt, Human
uuccagcugggcagauaguugagggcucccug

SEQ ID NO: 535206 - RNA, 32 nt, Human
uuccagcugugccucugcugccagccaagucu

SEQ ID NO: 535207 - RNA, 32 nt, Human
uuccagcuguguucuguggaggucacuuguga

SEQ ID NO: 535208 - RNA, 32 nt, Human
uuccagcuguguugcuggcaguguugucucaa

SEQ ID NO: 535209 - RNA, 20 nt, Human
uuccagcuguuggcucuuua

SEQ ID NO: 535210 - RNA, 32 nt, Human
uuccagcuucauggaccuggagaugugcccuu

SEQ ID NO: 535211 - RNA, 32 nt, Human
uuccaggaaaugcuuggauucauguggacauu

SEQ ID NO: 535212 - RNA, 32 nt, Human
uuccaggaacacaaaccccaacaagauccaau

SEQ ID NO: 535213 - RNA, 32 nt, Human
uuccaggaacucaggaucugcagugaggacca

SEQ ID NO: 535214 - RNA, 23 nt, Human
uuccaggaagagugugcuuguca

SEQ ID NO: 535215 - RNA, 32 nt, Human
uuccaggaagcacaggccaggggaucugggug

SEQ ID NO: 535216 - RNA, 22 nt, Human
uuccaggacaaacaucuuugga

SEQ ID NO: 535217 - RNA, 32 nt, Human
uuccaggaccccuguggcuaccaaaauccaug

SEQ ID NO: 535218 - RNA, 32 nt, Human
uuccaggacccuacaagagauggagaugucau

SEQ ID NO: 535219 - RNA, 32 nt, Human
uuccaggaccuccauuccacucaucucuggcc

SEQ ID NO: 535220 - RNA, 32 nt, Human
uuccaggacugggccagcuauggggguggcag

SEQ ID NO: 535221 - RNA, 32 nt, Human
uuccaggagaaaaauuccaagaguuacaaucu

SEQ ID NO: 535222 - RNA, 32 nt, Human
uuccaggagagaaagggaccgcuuggagcagu

SEQ ID NO: 535223 - RNA, 32 nt, Human
uuccaggaggcguuuggggguggggaaggcac

SEQ ID NO: 535224 - RNA, 32 nt, Human
uuccaggagggaucccaggaacugugggcacc

SEQ ID NO: 535225 - RNA, 32 nt, Human
uuccaggagggggaagaggaguggggaguggg

SEQ ID NO: 535226 - RNA, 32 nt, Human
uuccaggagucuuggcaucucauagcuugucc

SEQ ID NO: 535227 - RNA, 32 nt, Human
uuccaggcaaagcugcuucucuuccccagacc

SEQ ID NO: 535228 - RNA, 32 nt, Human
uuccaggcagagcacagcccacugccucccuc

SEQ ID NO: 535229 - RNA, 32 nt, Human
uuccaggccagccagaugggacugccuugucu

SEQ ID NO: 535230 - RNA, 32 nt, Human
uuccaggcccuugacugcuccuuugggcuggg

SEQ ID NO: 535231 - RNA, 32 nt, Human
uuccaggccugaucuugccugucuggcucagg

SEQ ID NO: 535232 - RNA, 32 nt, Human
uuccaggcucaagcgguccuucuaccucagcc

SEQ ID NO: 535233 - RNA, 22 nt, Human
uuccaggcucccugucuuuggg

SEQ ID NO: 535234 - RNA, 32 nt, Human
uuccaggcucucuucucucccucucucuccuu

SEQ ID NO: 535235 - RNA, 32 nt, Human
uuccaggcugcaaugcugaaucuugcugaauu

SEQ ID NO: 535236 - RNA, 32 nt, Human
uuccaggcuggagucgguuccacccacucgcc

SEQ ID NO: 535237 - RNA, 21 nt, Human
uuccaggcuggagugcagugg

SEQ ID NO: 535238 - RNA, 32 nt, Human
uuccaggcuggccucaaacuccugggcucaag

SEQ ID NO: 535239 - RNA, 32 nt, Human
uuccaggcugguaccaggucucaccaugggga

SEQ ID NO: 535240 - RNA, 32 nt, Human
uuccaggcuuacgacccugggcucacggguac

SEQ ID NO: 535241 - RNA, 32 nt, Human
uuccaggcuucaaagcugcacagagucuacgu

SEQ ID NO: 535242 - RNA, 21 nt, Human
uuccagggaaaauccucuuug

SEQ ID NO: 535243 - RNA, 22 nt, Human
uuccagggaaacacaugcugga

SEQ ID NO: 535244 - RNA, 32 nt, Human
uuccagggaaacacaugcuggacaucccuugu

SEQ ID NO: 535245 - RNA, 20 nt, Human
uuccagggaccuaugucuuu

SEQ ID NO: 535246 - RNA, 32 nt, Human
uuccagggagaggcagcugagaucagaagaga

SEQ ID NO: 535247 - RNA, 32 nt, Human
uuccagggagaggcagcugagaucagaaggga

SEQ ID NO: 535248 - RNA, 32 nt, Human
uuccagggagcagcaugggccccacugaaugg

SEQ ID NO: 535249 - RNA, 32 nt, Human
uuccagggagccaaagggggagccagagagcc

SEQ ID NO: 535250 - RNA, 32 nt, Human
uuccagggaggcggccggggcagggggcuuag

SEQ ID NO: 535251 - RNA, 32 nt, Human
uuccagggagugagaaaagcagcccggcuaga

SEQ ID NO: 535252 - RNA, 32 nt, Human
uuccagggauaaaaggaggcagacaagaacug

SEQ ID NO: 535253 - RNA, 32 nt, Human
uuccagggaucucugggcuggucuguggggcc

SEQ ID NO: 535254 - RNA, 32 nt, Human
uuccagggccagagaaggagaacuaggcaagu

SEQ ID NO: 535255 - RNA, 32 nt, Human
uuccagggccuuuucccacuaaguaguauugc

SEQ ID NO: 535256 - RNA, 32 nt, Human
uuccagggcugaaugccuucuuccugcaggcu

SEQ ID NO: 535257 - RNA, 32 nt, Human
uuccagggcugaggggacugagugagcugccu

SEQ ID NO: 535258 - RNA, 17 nt, Human
uuccaggggagguucag

SEQ ID NO: 535259 - RNA, 32 nt, Human
uuccaggggccucugugucccgcacugugugu

SEQ ID NO: 535260 - RNA, 32 nt, Human
uuccagggggcugaggcacacagagaggccaa

SEQ ID NO: 535261 - RNA, 20 nt, Human
uuccagggguccagggccag

SEQ ID NO: 535262 - RNA, 32 nt, Human
uuccaggguagaggaaugugccuccaauaaua

SEQ ID NO: 535263 - RNA, 32 nt, Human
uuccagggugccaagaaggaagaaaagcccca

SEQ ID NO: 535264 - RNA, 32 nt, Human
uuccaggguuuagggagugcagugaugucgau

SEQ ID NO: 535265 - RNA, 32 nt, Human
uuccagguacacaaugaaguuuuaaauguuua

SEQ ID NO: 535266 - RNA, 32 nt, Human
uuccagguacucaggaugaaugguuugaggac

SEQ ID NO: 535267 - RNA, 32 nt, Human
uuccaggucacugcaucugucucuccaccaug

SEQ ID NO: 535268 - RNA, 32 nt, Human
uuccaggucauucucucugacucucaucugca

SEQ ID NO: 535269 - RNA, 32 nt, Human
uuccagguccaggagucagcccugcaggcuca

SEQ ID NO: 535270 - RNA, 32 nt, Human
uuccaggugaugcuguuguugcuggucuagag

SEQ ID NO: 535271 - RNA, 32 nt, Human
uuccaggugcccuggcuggagucaguccucau

SEQ ID NO: 535272 - RNA, 32 nt, Human
uuccagguucaagugauucuccugccucagcc

SEQ ID NO: 535273 - RNA, 32 nt, Human
uuccagguucacgccauucuccugccucagcc

SEQ ID NO: 535274 - RNA, 18 nt, Human
uuccagguucuggcuccu

SEQ ID NO: 535275 - RNA, 32 nt, Human
uuccagguucuugggaggaagggagaaaagaa

SEQ ID NO: 535276 - RNA, 32 nt, Human
uuccagguuggcacagaugaugaggucugaga

SEQ ID NO: 535277 - RNA, 32 nt, Human
uuccaguacagcuguagcaagaugcgcaggca

SEQ ID NO: 535278 - RNA, 32 nt, Human
uuccaguaguuucacacaccacuuauggggaa

SEQ ID NO: 535279 - RNA, 32 nt, Human
uuccaguaugaccacacccaauaacuguuauu

SEQ ID NO: 535280 - RNA, 32 nt, Human
uuccagucauuauuguuacaucauguuugcag

SEQ ID NO: 535281 - RNA, 32 nt, Human
uuccaguccacguggauauaaugauaucuaua

SEQ ID NO: 535282 - RNA, 32 nt, Human
uuccaguccagcaugggucuggggaagaggag

SEQ ID NO: 535283 - RNA, 32 nt, Human
uuccaguccagccucagagaucaggcucuggg

SEQ ID NO: 535284 - RNA, 19 nt, Human
uuccaguccccacugacca

SEQ ID NO: 535285 - RNA, 32 nt, Human
uuccaguccuggaggcagguugugcagcuuag

SEQ ID NO: 535286 - RNA, 32 nt, Human
uuccagucgccuagcuagggccaaucacggag

SEQ ID NO: 535287 - RNA, 32 nt, Human
uuccagucgugugguuucucccauacccugac

SEQ ID NO: 535288 - RNA, 32 nt, Human
uuccagucuacaccaggccucuccaaggagac

SEQ ID NO: 535289 - RNA, 32 nt, Human
uuccagucucaagugauccucugccucagccu

SEQ ID NO: 535290 - RNA, 32 nt, Human
uuccagucugguugcagaaccugcacauuugc

SEQ ID NO: 535291 - RNA, 32 nt, Human
uuccagucuugcucugcccuccggagaugaca

SEQ ID NO: 535292 - RNA, 24 nt, Human
uuccagugacucaguugaaacuca

SEQ ID NO: 535293 - RNA, 32 nt, Human
uuccagugagcagcagcugcacguccgaggcu

SEQ ID NO: 535294 - RNA, 32 nt, Human
uuccagugagcuuaucaugcugucuuuacaug

SEQ ID NO: 535295 - RNA, 32 nt, Human
uuccagugaggagagccagccgggaggucagu

SEQ ID NO: 535296 - RNA, 32 nt, Human
uuccagugaggccaagggguccuggccggguu

SEQ ID NO: 535297 - RNA, 22 nt, Human
uuccagugauauucugcaauca

SEQ ID NO: 535298 - RNA, 32 nt, Human
uuccagugauuuucacugcugucaguagaaaa

SEQ ID NO: 535299 - RNA, 32 nt, Human
uuccagugcaccuguaggaacaacuagacuuc

SEQ ID NO: 535300 - RNA, 32 nt, Human
uuccagugccuauccgugggauccuucacguu

SEQ ID NO: 535301 - RNA, 32 nt, Human
uuccagugccugacuugggauaggacugagug

SEQ ID NO: 535302 - RNA, 32 nt, Human
uuccagugcucauucgugacacugcugcucuc

SEQ ID NO: 535303 - RNA, 32 nt, Human
uuccaguggaaaugucacuugcuacagacaau

SEQ ID NO: 535304 - RNA, 32 nt, Human
uuccaguggacccuggaccauuccaggaaaac

SEQ ID NO: 535305 - RNA, 32 nt, Human
uuccaguggaccugggcuguuguugcgguugu

SEQ ID NO: 535306 - RNA, 32 nt, Human
uuccaguggcucugccauagccccagacaagc

SEQ ID NO: 535307 - RNA, 32 nt, Human
uuccaguggugaggcagucugagaauguguga

SEQ ID NO: 535308 - RNA, 32 nt, Human
uuccaguguccuccccagccuccugagacucc

SEQ ID NO: 535309 - RNA, 32 nt, Human
uuccagugucuccugguaacuggaaccucucc

SEQ ID NO: 535310 - RNA, 32 nt, Human
uuccaguuagugacuuuugccccauaguuggg

SEQ ID NO: 535311 - RNA, 32 nt, Human
uuccaguucagacucuaacuucucccaaagug

SEQ ID NO: 535312 - RNA, 32 nt, Human
uuccaguuccacccuuuccugcggcaccacca

SEQ ID NO: 535313 - RNA, 32 nt, Human
uuccaguuccacccuuuccugcggcaccaccu

SEQ ID NO: 535314 - RNA, 32 nt, Human
uuccaguugcaagugauucuccugccucagcc

SEQ ID NO: 535315 - RNA, 32 nt, Human
uuccaguugucacuauccuugacucauugcac

SEQ ID NO: 535316 - RNA, 32 nt, Human
uuccaguuuacugaacuccagaccaugcaugu

SEQ ID NO: 535317 - RNA, 32 nt, Human
uuccaguuucaggugauccuccugccucagcc

SEQ ID NO: 535318 - RNA, 32 nt, Human
uuccaguuuuccccuugcuucccaggcccuug

SEQ ID NO: 535319 - RNA, 32 nt, Human
uuccaguuuucuucaaacaaugcuucagugaa

SEQ ID NO: 535320 - RNA, 32 nt, Human
uuccauaaagaauggcccuuguggauaagcac

SEQ ID NO: 535321 - RNA, 32 nt, Human
uuccauaaagaguagcucaaaauaugcaauua

SEQ ID NO: 535322 - RNA, 32 nt, Human
uuccauaauaaacuguuaggugcucuugaaga

SEQ ID NO: 535323 - RNA, 21 nt, Human
uuccauaaucacucagugauu

SEQ ID NO: 535324 - RNA, 32 nt, Human
uuccauacacauccccagccagaaguuagugu

SEQ ID NO: 535325 - RNA, 32 nt, Human
uuccauacagcagugccuauauagugacugau

SEQ ID NO: 535326 - RNA, 32 nt, Human
uuccauacgaguuuugguuuuguuuuuaauau

SEQ ID NO: 535327 - RNA, 32 nt, Human
uuccauacugaaagaagagcaaauacaaaagc

SEQ ID NO: 535328 - RNA, 32 nt, Human
uuccauacugaguuuaaaauuuauuaauuugu

SEQ ID NO: 535329 - RNA, 18 nt, Human
uuccauagauagcuuuuu

SEQ ID NO: 535330 - RNA, 32 nt, Human
uuccauagccaucuacucucuugagccuuugg

SEQ ID NO: 535331 - RNA, 32 nt, Human
uuccauaggacccagugcuuucaucuccgugc

SEQ ID NO: 535332 - RNA, 32 nt, Human
uuccauagucaccuacuuccuguccuccucgg

SEQ ID NO: 535333 - RNA, 32 nt, Human
uuccauagucuuuguccccaagggccuuccag

SEQ ID NO: 535334 - RNA, 32 nt, Human
uuccauauaccugauagucuguguacagcauu

SEQ ID NO: 535335 - RNA, 32 nt, Human
uuccauauaugccaccagccaaguggccaucc

SEQ ID NO: 535336 - RNA, 32 nt, Human
uuccauaucuacuuacacauacaccagcaaca

SEQ ID NO: 535337 - RNA, 32 nt, Human
uuccauaucugugggcuuuguucuacauuugg

SEQ ID NO: 535338 - RNA, 32 nt, Human
uuccauauguguguccucucuuccacaccaua

SEQ ID NO: 535339 - RNA, 31 nt, Human
uuccauauguugagauucuacuuauucauca

SEQ ID NO: 535340 - RNA, 32 nt, Human
uuccaucaaagccucccccucccccaccccuu

SEQ ID NO: 535341 - RNA, 32 nt, Human
uuccaucaaauuuuaaguuaucuuuaaccccu

SEQ ID NO: 535342 - RNA, 32 nt, Human
uuccaucaagcaccagaguugcaguggcuugg

SEQ ID NO: 535343 - RNA, 32 nt, Human
uuccaucacaugcuucuuaggcagcagggagc

SEQ ID NO: 535344 - RNA, 32 nt, Human
uuccaucaccacccuugucucucuacacauuu

SEQ ID NO: 535345 - RNA, 32 nt, Human
uuccaucacccacugcaaccagccagcugccg

SEQ ID NO: 535346 - RNA, 32 nt, Human
uuccaucagaaggugcccagcgcuacuuccca

SEQ ID NO: 535347 - RNA, 32 nt, Human
uuccaucagugucuuccagccugcauggggag

SEQ ID NO: 535348 - RNA, 32 nt, Human
uuccaucaugacccuuggacugggugagagca

SEQ ID NO: 535349 - RNA, 32 nt, Human
uuccaucaugagugcagugucaucucagcggg

SEQ ID NO: 535350 - RNA, 32 nt, Human
uuccauccaucuuuccauccauuaccuccauc

SEQ ID NO: 535351 - RNA, 32 nt, Human
uuccaucccagaaaguccugcgggacagauuc

SEQ ID NO: 535352 - RNA, 32 nt, Human
uuccauccccacggaugguguugcugcugggc

SEQ ID NO: 535353 - RNA, 32 nt, Human
uuccauccccaguccagccugggcaaccccac

SEQ ID NO: 535354 - RNA, 32 nt, Human
uuccauccccauggggcagaaacaguggcucc

SEQ ID NO: 535355 - RNA, 32 nt, Human
uuccauccccucucuacauccuucagcuguca

SEQ ID NO: 535356 - RNA, 32 nt, Human
uuccaucccucgggcccagcaguacacacuug

SEQ ID NO: 535357 - RNA, 32 nt, Human
uuccaucccucuguucaguugugaggaccucu

SEQ ID NO: 535358 - RNA, 32 nt, Human
uuccauccguucuccucuggggugaguggagg

SEQ ID NO: 535359 - RNA, 32 nt, Human
uuccauccuguaauccuagcacuuuaaaagga

SEQ ID NO: 535360 - RNA, 32 nt, Human
uuccauccuguauaccuggcucugccuuuuag

SEQ ID NO: 535361 - RNA, 32 nt, Human
uuccaucgugaagccuuuaaucaucuuaccca

SEQ ID NO: 535362 - RNA, 32 nt, Human
uuccaucuaggcucaccucuugcucacucuga

SEQ ID NO: 535363 - RNA, 32 nt, Human
uuccaucuauccuaaccugaccaguacauauu

SEQ ID NO: 535364 - RNA, 32 nt, Human
uuccaucuccacccaucucuacaucugggcac

SEQ ID NO: 535365 - RNA, 32 nt, Human
uuccaucucccuucucccuugucaucagacac

SEQ ID NO: 535366 - RNA, 32 nt, Human
uuccaucucuccccucuugaccuuccacccac

SEQ ID NO: 535367 - RNA, 32 nt, Human
uuccaucucugagauauguggucuugaccucc

SEQ ID NO: 535368 - RNA, 32 nt, Human
uuccaucugcaaaaccaggcucccaggggaug

SEQ ID NO: 535369 - RNA, 16 nt, Human
uuccaucugccugcca

SEQ ID NO: 535370 - RNA, 32 nt, Human
uuccaucugggcaaccugguuuuccaaauauc

SEQ ID NO: 535371 - RNA, 32 nt, Human
uuccaucuggggccaaccccaggcugggccug

SEQ ID NO: 535372 - RNA, 32 nt, Human
uuccaucuguaugccauuguucaugccuuaag

SEQ ID NO: 535373 - RNA, 32 nt, Human
uuccaucugucuuuucuaccugugccaccccu

SEQ ID NO: 535374 - RNA, 32 nt, Human
uuccaucuguuuaguggaugguuggcaggauu

SEQ ID NO: 535375 - RNA, 32 nt, Human
uuccaucuuccagagacaugaagccauuauua

SEQ ID NO: 535376 - RNA, 32 nt, Human
uuccaucuugaaugaaaauacauaucauuuug

SEQ ID NO: 535377 - RNA, 32 nt, Human
uuccaucuugcuggggcucugaagggggucaa

SEQ ID NO: 535378 - RNA, 32 nt, Human
uuccaucuuggaugcuaaucuaccauguugac

SEQ ID NO: 535379 - RNA, 32 nt, Human
uuccaucuuuucucccauuccuccuucuuuau

SEQ ID NO: 535380 - RNA, 32 nt, Human
uuccaugaacaguugaaaaauggaauugacuu

SEQ ID NO: 535381 - RNA, 32 nt, Human
uuccaugaacccaggaugcggagguugcagug

SEQ ID NO: 535382 - RNA, 32 nt, Human
uuccaugaacuccuccuccauuuccuuuuugg

SEQ ID NO: 535383 - RNA, 32 nt, Human
uuccaugaagaaaaauauauguucuuuugaau

SEQ ID NO: 535384 - RNA, 32 nt, Human
uuccaugaauauuacaggcugagaaggagcac

SEQ ID NO: 535385 - RNA, 32 nt, Human
uuccaugacuccaggcugugccucucuccaug

SEQ ID NO: 535386 - RNA, 32 nt, Human
uuccaugagaaggugaccccauaccuugcccu

SEQ ID NO: 535387 - RNA, 32 nt, Human
uuccaugagacaggccagcgugugugggguag

SEQ ID NO: 535388 - RNA, 32 nt, Human
uuccaugagcugagucucugccucugccucuc

SEQ ID NO: 535389 - RNA, 32 nt, Human
uuccaugaggcaggcuugcaggagcaagggag

SEQ ID NO: 535390 - RNA, 32 nt, Human
uuccaugagucuucagaagaaaggacagcuca

SEQ ID NO: 535391 - RNA, 32 nt, Human
uuccaugaucacugggaccuacugccucagga

SEQ ID NO: 535392 - RNA, 20 nt, Human
uuccaugcacucuucaugua

SEQ ID NO: 535393 - RNA, 32 nt, Human
uuccaugcagauuugugcacaugugagagggu

SEQ ID NO: 535394 - RNA, 32 nt, Human
uuccaugccuccaggaguguggcagagcuucu

SEQ ID NO: 535395 - RNA, 32 nt, Human
uuccaugcuacucaucccaaaacuugaucuca

SEQ ID NO: 535396 - RNA, 32 nt, Human
uuccaugcuggccccggcaucugcugugugcu

SEQ ID NO: 535397 - RNA, 32 nt, Human
uuccaugcuguggaggcucuguuguuucgcuc

SEQ ID NO: 535398 - RNA, 32 nt, Human
uuccauggaaacauggcagcuaggacacgggg

SEQ ID NO: 535399 - RNA, 32 nt, Human
uuccauggacgggguggugguggaggaugaaa

SEQ ID NO: 535400 - RNA, 30 nt, Human
uuccauggacuuuccagggcacagucaucu

SEQ ID NO: 535401 - RNA, 31 nt, Human
uuccauggacuuuucuagagauguagacauu

SEQ ID NO: 535402 - RNA, 22 nt, Human
uuccauggagagaagagugauc

SEQ ID NO: 535403 - RNA, 32 nt, Human
uuccauggagccaagagggugcagguuggcag

SEQ ID NO: 535404 - RNA, 32 nt, Human
uuccauggagccagaccggguggaggggcuuc

SEQ ID NO: 535405 - RNA, 32 nt, Human
uuccauggaguaagaaggaagggagcauguac

SEQ ID NO: 535406 - RNA, 32 nt, Human
uuccauggcaggaagaugagaagaaaucuuca

SEQ ID NO: 535407 - RNA, 32 nt, Human
uuccauggccuucugcuguuucucgccaacac

SEQ ID NO: 535408 - RNA, 32 nt, Human
uuccauggccuuuauuucuccucuuccagugg

SEQ ID NO: 535409 - RNA, 32 nt, Human
uuccauggcucuguuaugcaagcacaaauuuc

SEQ ID NO: 535410 - RNA, 32 nt, Human
uuccaugggccacuguuucccuuggggugggg

SEQ ID NO: 535411 - RNA, 32 nt, Human
uuccaugggcuuuccaggucacacgaccuaca

SEQ ID NO: 535412 - RNA, 32 nt, Human
uuccauggggaggaugcugagugagcaguuuc

SEQ ID NO: 535413 - RNA, 32 nt, Human
uuccauggucucaaugacuuaaguuuauggga

SEQ ID NO: 535414 - RNA, 32 nt, Human
uuccauggugcuggccgugugcugcuucuuga

SEQ ID NO: 535415 - RNA, 32 nt, Human
uuccaugguuucagguuuuccuucccuuccuu

SEQ ID NO: 535416 - RNA, 32 nt, Human
uuccauguccccucccagagcugguggaccca

SEQ ID NO: 535417 - RNA, 32 nt, Human
uuccauguccccuuggauguaggaauggucau

SEQ ID NO: 535418 - RNA, 32 nt, Human
uuccaugugcaaggcagguuccagacuucggg

SEQ ID NO: 535419 - RNA, 32 nt, Human
uuccauguggcuuugcccucuguucuucuccu

SEQ ID NO: 535420 - RNA, 32 nt, Human
uuccauguguccacugucuagcacagggcaau

SEQ ID NO: 535421 - RNA, 32 nt, Human
uuccauguugcauuuaugaagggagaagguuc

SEQ ID NO: 535422 - RNA, 32 nt, Human
uuccauguugcccaggcuggucucgaacuccu

SEQ ID NO: 535423 - RNA, 32 nt, Human
uuccauguugcccaggcugguuucgaacucgg

SEQ ID NO: 535424 - RNA, 32 nt, Human
uuccauguuuuaccuauaacaagucuaagaaa

SEQ ID NO: 535425 - RNA, 32 nt, Human
uuccauguuuucuuguuuaucacacauacaag

SEQ ID NO: 535426 - RNA, 32 nt, Human
uuccauguuuuuaaaagauuacuuucuacuuu

SEQ ID NO: 535427 - RNA, 32 nt, Human
uuccauuaauuaacucaggucuggaagacaua

SEQ ID NO: 535428 - RNA, 32 nt, Human
uuccauuacacuccagccugggcaccaggaac

SEQ ID NO: 535429 - RNA, 32 nt, Human
uuccauuacacugugaaugauaccuguuuugu

SEQ ID NO: 535430 - RNA, 17 nt, Human
uuccauuagcaauagcu

SEQ ID NO: 535431 - RNA, 32 nt, Human
uuccauuaggcuccugagaguuauuucucagg

SEQ ID NO: 535432 - RNA, 32 nt, Human
uuccauuaugaugaguaugugcagugauacua

SEQ ID NO: 535433 - RNA, 32 nt, Human
uuccauucacuuugucauuccaccucuaagaa

SEQ ID NO: 535434 - RNA, 32 nt, Human
uuccauucagguaccaucaccuggucccauca

SEQ ID NO: 535435 - RNA, 32 nt, Human
uuccauuccagaauaucugggauucuacuuua

SEQ ID NO: 535436 - RNA, 32 nt, Human
uuccauuccauaucagguacaggauuugaugu

SEQ ID NO: 535437 - RNA, 22 nt, Human
uuccauuccugggccugccucu

SEQ ID NO: 535438 - RNA, 32 nt, Human
uuccauucuaaccuugagccacagugucacuc

SEQ ID NO: 535439 - RNA, 32 nt, Human
uuccauucuauaauaaaacagaaacaagaguc

SEQ ID NO: 535440 - RNA, 24 nt, Human
uuccauucugaacauguuuuguca

SEQ ID NO: 535441 - RNA, 32 nt, Human
uuccauucugcaggaguuuuagcuauuugaga

SEQ ID NO: 535442 - RNA, 32 nt, Human
uuccauucuggcaaaaucuugccuuaucagaa

SEQ ID NO: 535443 - RNA, 32 nt, Human
uuccauucuguggagcugccguuccuaauaau

SEQ ID NO: 535444 - RNA, 32 nt, Human
uuccauucuuuaaggcagacggcauuccucuu

SEQ ID NO: 535445 - RNA, 32 nt, Human
uuccauugaaaggggaaaaaugaagagaaaca

SEQ ID NO: 535446 - RNA, 32 nt, Human
uuccauugcccacuuucuucucccucuccuuu

SEQ ID NO: 535447 - RNA, 32 nt, Human
uuccauugcuagcuguccugcuguuuaacaca

SEQ ID NO: 535448 - RNA, 32 nt, Human
uuccauugcucuauuugucucuccuuaaacua

SEQ ID NO: 535449 - RNA, 32 nt, Human
uuccauuguagccaggcaguuggggcacuuuc

SEQ ID NO: 535450 - RNA, 32 nt, Human
uuccauuuaaggaacagugcaccccaccccag

SEQ ID NO: 535451 - RNA, 32 nt, Human
uuccauuuacaagcaagcaggccaggcaacug

SEQ ID NO: 535452 - RNA, 32 nt, Human
uuccauuuacagucucuuucuuccuuucuaau

SEQ ID NO: 535453 - RNA, 32 nt, Human
uuccauuuaccugaguucgcuuuaaagagcuu

SEQ ID NO: 535454 - RNA, 32 nt, Human
uuccauuuauagaccaccuccagccagugacg

SEQ ID NO: 535455 - RNA, 32 nt, Human
uuccauuucauuuuggccauuauagucacauc

SEQ ID NO: 535456 - RNA, 32 nt, Human
uuccauuuccaguucaucuauggcaguccagc

SEQ ID NO: 535457 - RNA, 32 nt, Human
uuccauuucuccccaccucacucucaccaagu

SEQ ID NO: 535458 - RNA, 32 nt, Human
uuccauuucucucuucagccucaggccaaaca

SEQ ID NO: 535459 - RNA, 32 nt, Human
uuccauuugccucuaugaucuuagcucauaaa

SEQ ID NO: 535460 - RNA, 32 nt, Human
uuccauuugccuuccuggaauccugcugcauc

SEQ ID NO: 535461 - RNA, 32 nt, Human
uuccauuuggcuucucaccugggaaauacaaa

SEQ ID NO: 535462 - RNA, 32 nt, Human
uuccauuuguauucuggcugggugaugagcaa

SEQ ID NO: 535463 - RNA, 32 nt, Human
uuccauuugucaccccagcagaauguccggca

SEQ ID NO: 535464 - RNA, 32 nt, Human
uuccauuuuccaaauuccagcacacagagauc

SEQ ID NO: 535465 - RNA, 31 nt, Human
uuccauuuucucucugggccuguauccaugg

SEQ ID NO: 535466 - RNA, 32 nt, Human
uuccauuuugaacuuugaggacuguuggucag

SEQ ID NO: 535467 - RNA, 31 nt, Human
uuccauuuugagagagaagaaaaacuguuug

SEQ ID NO: 535468 - RNA, 32 nt, Human
uucccaaaaggcaggugcaaugaugcacacuu

SEQ ID NO: 535469 - RNA, 32 nt, Human
uucccaaaaugcugggauuacaagcaugcguc

SEQ ID NO: 535470 - RNA, 32 nt, Human
uucccaaacaaaccaucucuccauuggaaaag

SEQ ID NO: 535471 - RNA, 32 nt, Human
uucccaaacacagucagacucuucccauuguc

SEQ ID NO: 535472 - RNA, 32 nt, Human
uucccaaagggagcagggagaugggaauagaa

SEQ ID NO: 535473 - RNA, 32 nt, Human
uucccaaagggaggguggcagagacagugggc

SEQ ID NO: 535474 - RNA, 32 nt, Human
uucccaaaguccugggauuacaggugugagcc

SEQ ID NO: 535475 - RNA, 32 nt, Human
uucccaaagugcagggauuacaagugugggcc

SEQ ID NO: 535476 - RNA, 32 nt, Human
uucccaaagugcucggauuacaggugugagcc

SEQ ID NO: 535477 - RNA, 32 nt, Human
uucccaaagugcugagauuacaggcaugagcc

SEQ ID NO: 535478 - RNA, 32 nt, Human
uucccaaagugcugagauuacaggcaugagcu

SEQ ID NO: 535479 - RNA, 32 nt, Human
uucccaaagugcugagauuacaggcaugggcc

SEQ ID NO: 535480 - RNA, 32 nt, Human
uucccaaagugcugagauuacaggugugagcc

SEQ ID NO: 535481 - RNA, 32 nt, Human
uucccaaagugcuggaauuacaggccugagcc

SEQ ID NO: 535482 - RNA, 32 nt, Human
uucccaaagugcuggaauuacaggcgugagcc

SEQ ID NO: 535483 - RNA, 32 nt, Human
uucccaaagugcuggcauuacaggcgugagcc

SEQ ID NO: 535484 - RNA, 32 nt, Human
uucccaaagugcugggaauacaggugugaacc

SEQ ID NO: 535485 - RNA, 32 nt, Human
uucccaaagugcugggauuacagacaugagcc

SEQ ID NO: 535486 - RNA, 32 nt, Human
uucccaaagugcugggauuacaggaaugagcc

SEQ ID NO: 535487 - RNA, 32 nt, Human
uucccaaagugcugggauuacaggcaugagcc

SEQ ID NO: 535488 - RNA, 32 nt, Human
uucccaaagugcugggauuacaggcgggagcc

SEQ ID NO: 535489 - RNA, 32 nt, Human
uucccaaagugcugggauuacaggcgugagcc

SEQ ID NO: 535490 - RNA, 32 nt, Human
uucccaaagugcugggauuacaggcgugcacc

SEQ ID NO: 535491 - RNA, 32 nt, Human
uucccaaagugcugggauuacaggcuugagcc

SEQ ID NO: 535492 - RNA, 32 nt, Human
uucccaaagugcugggauuacaggugugagcc

SEQ ID NO: 535493 - RNA, 32 nt, Human
uucccaaagugcugggauuacaggugugaguc

SEQ ID NO: 535494 - RNA, 32 nt, Human
uucccaaagugcugggauuacgggcgugagcc

SEQ ID NO: 535495 - RNA, 32 nt, Human
uucccaaagugcugggauuauaggcagcacua

SEQ ID NO: 535496 - RNA, 32 nt, Human
uucccaaagugcugggauuauaggcaugugcc

SEQ ID NO: 535497 - RNA, 32 nt, Human
uucccaaagugcugggauuaugggcgggugug

SEQ ID NO: 535498 - RNA, 32 nt, Human
uucccaaagugcugggauugcaggcgugagcc

SEQ ID NO: 535499 - RNA, 32 nt, Human
uucccaaaguguugggauuacaggcaugagcu

SEQ ID NO: 535500 - RNA, 32 nt, Human
uucccaaaguucugggauuacaggcaugagcc

SEQ ID NO: 535501 - RNA, 32 nt, Human
uucccaaauccuuccuuccucccagcaccccu

SEQ ID NO: 535502 - RNA, 32 nt, Human
uucccaaaucuaguggaggacagggcaaggga

SEQ ID NO: 535503 - RNA, 18 nt, Human
uucccaaaucugcuccag

SEQ ID NO: 535504 - RNA, 32 nt, Human
uucccaaaugcaggcagaucugagaggggcuc

SEQ ID NO: 535505 - RNA, 32 nt, Human
uucccaaauguagacuagaaucugcaggaugc

SEQ ID NO: 535506 - RNA, 32 nt, Human
uucccaaaugugccacuuuucuguuggcucac

SEQ ID NO: 535507 - RNA, 32 nt, Human
uucccaacagcaguugggguguccuguugauu

SEQ ID NO: 535508 - RNA, 32 nt, Human
uucccaacauggugaaaccccaucucuacuaa

SEQ ID NO: 535509 - RNA, 25 nt, Human
uucccaaccuccugugggccucaag

SEQ ID NO: 535510 - RNA, 32 nt, Human
uucccaaccugucccaguuugucugggaucaa

SEQ ID NO: 535511 - RNA, 32 nt, Human
uucccaacuuguccggaaguguuuccagaaua

SEQ ID NO: 535512 - RNA, 32 nt, Human
uucccaagaggagccaucccacauuuggguag

SEQ ID NO: 535513 - RNA, 24 nt, Human
uucccaagcagcugggauuacagg

SEQ ID NO: 535514 - RNA, 30 nt, Human
uucccaagccacugcacuucggaggggcug

SEQ ID NO: 535515 - RNA, 32 nt, Human
uucccaagcuguuuguucuccacaauaggcuc

SEQ ID NO: 535516 - RNA, 23 nt, Human
uucccaagcuucucaaacuguua

SEQ ID NO: 535517 - RNA, 32 nt, Human
uucccaaggucacacagcccagaagagauggg

SEQ ID NO: 535518 - RNA, 32 nt, Human
uucccaaggugcuggaauuacaggcgugagcc

SEQ ID NO: 535519 - RNA, 32 nt, Human
uucccaaguagcggggaucacaggcaugagcc

SEQ ID NO: 535520 - RNA, 32 nt, Human
uucccaaguagcugagauuacaggcgcacacc

SEQ ID NO: 535521 - RNA, 32 nt, Human
uucccaaguagcugcaacaacaggcacacacc

SEQ ID NO: 535522 - RNA, 24 nt, Human
uucccaaguagcugggauuacagg

SEQ ID NO: 535523 - RNA, 32 nt, Human
uucccaaguagcugggauuacaggcacccacc

SEQ ID NO: 535524 - RNA, 32 nt, Human
uucccaaguagcugggauuacaggcacgugcc

SEQ ID NO: 535525 - RNA, 32 nt, Human
uucccaaguagcugggauuacaggcguacgcc

SEQ ID NO: 535526 - RNA, 32 nt, Human
uucccaaguagcugggauuuacaggugugcac

SEQ ID NO: 535527 - RNA, 32 nt, Human
uucccaaguaguugggauuacaggcgccugcc

SEQ ID NO: 535528 - RNA, 32 nt, Human
uucccaaguccaggaagagaaauguaagauuc

SEQ ID NO: 535529 - RNA, 32 nt, Human
uucccaaguccaugcuuuaaaggguuugcaag

SEQ ID NO: 535530 - RNA, 32 nt, Human
uucccaagugccugaucauaccucccagucuc

SEQ ID NO: 535531 - RNA, 24 nt, Human
uucccaaguggcugggauuacagg

SEQ ID NO: 535532 - RNA, 32 nt, Human
uucccaaguggcugggauuacaggcaugugcc

SEQ ID NO: 535533 - RNA, 32 nt, Human
uucccaaguggcugggauuacaggcgcccacc

SEQ ID NO: 535534 - RNA, 20 nt, Human
uucccaaguucgaaaaagaa

SEQ ID NO: 535535 - RNA, 32 nt, Human
uucccaaguugaagccuagacuucuggcucaa

SEQ ID NO: 535536 - RNA, 27 nt, Human
uucccaauaaagcgugcucuuucacaa

SEQ ID NO: 535537 - RNA, 32 nt, Human
uucccaaucagcacugaaaauaccaucaggcc

SEQ ID NO: 535538 - RNA, 32 nt, Human
uucccaauuaggaauucaauguggaaaacaua

SEQ ID NO: 535539 - RNA, 32 nt, Human
uucccacaaaccucaacaugugccagucaccc

SEQ ID NO: 535540 - RNA, 22 nt, Human
uucccacaaaggaaguaaccuu

SEQ ID NO: 535541 - RNA, 32 nt, Human
uucccacacagcugguagcucauucuggaaag

SEQ ID NO: 535542 - RNA, 32 nt, Human
uucccacacaugcagacauguacacacgugca

SEQ ID NO: 535543 - RNA, 32 nt, Human
uucccacaccuguaaucucagcacuuuaggag

SEQ ID NO: 535544 - RNA, 32 nt, Human
uucccacacucgugcauacacacacauccaua

SEQ ID NO: 535545 - RNA, 32 nt, Human
uucccacagccaaagccccauccccuucauuu

SEQ ID NO: 535546 - RNA, 32 nt, Human
uucccacagcuugccccacaccaccuucacac

SEQ ID NO: 535547 - RNA, 32 nt, Human
uucccacagguucuggaggagcccaggaugga

SEQ ID NO: 535548 - RNA, 32 nt, Human
uucccacaguggcuucacagacccacaagaga

SEQ ID NO: 535549 - RNA, 32 nt, Human
uucccacauacaccugagccacuguggugggu

SEQ ID NO: 535550 - RNA, 18 nt, Human
uucccacauccugagaaa

SEQ ID NO: 535551 - RNA, 32 nt, Human
uucccacaucuuccugucuucuucugagccuu

SEQ ID NO: 535552 - RNA, 32 nt, Human
uucccaccaaccagcucccaaacagaaagugu

SEQ ID NO: 535553 - RNA, 32 nt, Human
uucccaccaaggucuucagccaucaacaagag

SEQ ID NO: 535554 - RNA, 23 nt, Human
uucccaccacagacuggcuugua

SEQ ID NO: 535555 - RNA, 32 nt, Human
uucccaccacuucccaggcucugacagccgag

SEQ ID NO: 535556 - RNA, 32 nt, Human
uucccaccaggcaauuuggacugucuuugaau

SEQ ID NO: 535557 - RNA, 32 nt, Human
uucccacccaagcuuccggcagccuggcucca

SEQ ID NO: 535558 - RNA, 19 nt, Human
uucccacccacagccccca

SEQ ID NO: 535559 - RNA, 32 nt, Human
uucccacccagccuggcuggcggugcccacag

SEQ ID NO: 535560 - RNA, 32 nt, Human
uucccacccagcugcgcccucggcucggucuc

SEQ ID NO: 535561 - RNA, 32 nt, Human
uucccacccccugccugcccagccugggcccu

SEQ ID NO: 535562 - RNA, 32 nt, Human
uucccaccccuauacccuaggucuccaccccu

SEQ ID NO: 535563 - RNA, 32 nt, Human
uucccaccccuuagucuuuccccaccgagucc

SEQ ID NO: 535564 - RNA, 32 nt, Human
uucccaccgagccgagcuuacugugagugugg

SEQ ID NO: 535565 - RNA, 32 nt, Human
uucccaccgcaucguccgccucagccagaacc

SEQ ID NO: 535566 - RNA, 23 nt, Human
uucccaccuuccauagccuccaa

SEQ ID NO: 535567 - RNA, 32 nt, Human
uucccaccuuuuccuuuuucuucuuucuuguc

SEQ ID NO: 535568 - RNA, 32 nt, Human
uucccacuaaguugugugugaggaaauccuca

SEQ ID NO: 535569 - RNA, 32 nt, Human
uucccacucacggauaagacaccaagacguag

SEQ ID NO: 535570 - RNA, 32 nt, Human
uucccacucccccauuccucuggucucuuuuc

SEQ ID NO: 535571 - RNA, 32 nt, Human
uucccacucccuacuucugccaccccaccaac

SEQ ID NO: 535572 - RNA, 22 nt, Human
uucccacucccuuggguugcug

SEQ ID NO: 535573 - RNA, 32 nt, Human
uucccacucucauuaauccaucauguuccuaa

SEQ ID NO: 535574 - RNA, 19 nt, Human
uucccacucuuucgugguu

SEQ ID NO: 535575 - RNA, 32 nt, Human
uucccacugauccuucugggccacguugugcg

SEQ ID NO: 535576 - RNA, 32 nt, Human
uucccacugcacuccagccugagugacagagc

SEQ ID NO: 535577 - RNA, 32 nt, Human
uucccacugcacuccagccuggccaauaagac

SEQ ID NO: 535578 - RNA, 32 nt, Human
uucccacugcugucccugggccucugcccuug

SEQ ID NO: 535579 - RNA, 32 nt, Human
uucccacuggggacacagacacaggaaguagc

SEQ ID NO: 535580 - RNA, 32 nt, Human
uucccacugucauuccuaaccugggauuucua

SEQ ID NO: 535581 - RNA, 32 nt, Human
uucccagaaccagcggcccccuuuguaagaug

SEQ ID NO: 535582 - RNA, 28 nt, Human
uucccagaagcugcugccucuuccugag

SEQ ID NO: 535583 - RNA, 32 nt, Human
uucccagaagugagacugcuggauuauaugcu

SEQ ID NO: 535584 - RNA, 32 nt, Human
uucccagaaguuggacgaagaggcucaggcgu

SEQ ID NO: 535585 - RNA, 32 nt, Human
uucccagaauccauuccauuugugauuccaug

SEQ ID NO: 535586 - RNA, 32 nt, Human
uucccagaccugcuuccagucuuuauugcuuu

SEQ ID NO: 535587 - RNA, 19 nt, Human
uucccagaccuggcugucu

SEQ ID NO: 535588 - RNA, 32 nt, Human
uucccagacgaaaacucacgcccuugcccuaa

SEQ ID NO: 535589 - RNA, 32 nt, Human
uucccagacuccaagcuccuggcuccuguguu

SEQ ID NO: 535590 - RNA, 32 nt, Human
uucccagacucugccuccugguuuccuuucuc

SEQ ID NO: 535591 - RNA, 32 nt, Human
uucccagagaaaaguccaauagcuggugggaa

SEQ ID NO: 535592 - RNA, 32 nt, Human
uucccagagcagcacccacaaaagcaagcauu

SEQ ID NO: 535593 - RNA, 32 nt, Human
uucccagagcaucuugcauccaaaccuguaac

SEQ ID NO: 535594 - RNA, 32 nt, Human
uucccagagcccagggucgugauauauacauc

SEQ ID NO: 535595 - RNA, 32 nt, Human
uucccagaggcggggaggucucaggggucugu

SEQ ID NO: 535596 - RNA, 32 nt, Human
uucccagagggugcaggagccagcucugacua

SEQ ID NO: 535597 - RNA, 32 nt, Human
uucccagagugcugggauuacaggcgugagcc

SEQ ID NO: 535598 - RNA, 32 nt, Human
uucccagcaaccuggggcugguucccagugcc

SEQ ID NO: 535599 - RNA, 32 nt, Human
uucccagcagugggggucagacgcccuuccuc

SEQ ID NO: 535600 - RNA, 32 nt, Human
uucccagcaucagccuuagaacaagaaccuua

SEQ ID NO: 535601 - RNA, 32 nt, Human
uucccagccagggacauggagcagggcaccug

SEQ ID NO: 535602 - RNA, 32 nt, Human
uucccagcccaccagccugacgcccagccagg

SEQ ID NO: 535603 - RNA, 32 nt, Human
uucccagcccaggagcugaggggugagggcug

SEQ ID NO: 535604 - RNA, 32 nt, Human
uucccagcccucaaaacuaacauaucuuccag

SEQ ID NO: 535605 - RNA, 32 nt, Human
uucccagcccucaaggagcuacgugccaagga

SEQ ID NO: 535606 - RNA, 32 nt, Human
uucccagcccugggaggaagggggagucauuu

SEQ ID NO: 535607 - RNA, 32 nt, Human
uucccagccgcacacuuccucccuccagccgu

SEQ ID NO: 535608 - RNA, 32 nt, Human
uucccagccucaccaccccuucucaguaauga

SEQ ID NO: 535609 - RNA, 32 nt, Human
uucccagccuccagaacuaugggaaaauaaau

SEQ ID NO: 535610 - RNA, 32 nt, Human
uucccagccuccagaacucugggaaaauaaag

SEQ ID NO: 535611 - RNA, 32 nt, Human
uucccagccuccagaacugugagaaagaaauc

SEQ ID NO: 535612 - RNA, 32 nt, Human
uucccagccuccagaacugugagaaauaaauu

SEQ ID NO: 535613 - RNA, 32 nt, Human
uucccagccuccagaauugugagaaauaaauu

SEQ ID NO: 535614 - RNA, 32 nt, Human
uucccagccuccagagaugugaggaauacauc

SEQ ID NO: 535615 - RNA, 32 nt, Human
uucccagccuccagagcuguaagaaaauaaau

SEQ ID NO: 535616 - RNA, 32 nt, Human
uucccagccucgcugguaguccuggucaagga

SEQ ID NO: 535617 - RNA, 32 nt, Human
uucccagccucuuuuacuagucuuucaggagg

SEQ ID NO: 535618 - RNA, 32 nt, Human
uucccagccugucauaauggccaccuugcaga

SEQ ID NO: 535619 - RNA, 32 nt, Human
uucccagccuuccuccugaccccuuccaacag

SEQ ID NO: 535620 - RNA, 32 nt, Human
uucccagcgugaaaagagagacugcgcggccg

SEQ ID NO: 535621 - RNA, 31 nt, Human
uucccagcuacucaggagguugaggugggag

SEQ ID NO: 535622 - RNA, 19 nt, Human
uucccagcuacugcagcuu

SEQ ID NO: 535623 - RNA, 31 nt, Human
uucccagcuacuugggagguugagggaggag

SEQ ID NO: 535624 - RNA, 32 nt, Human
uucccagcuagaccugugugagaggugucugg

SEQ ID NO: 535625 - RNA, 32 nt, Human
uucccagcuaucuccccugcuccucugcuggu

SEQ ID NO: 535626 - RNA, 32 nt, Human
uucccagcucaagugauccuccuaccucagcc

SEQ ID NO: 535627 - RNA, 32 nt, Human
uucccagcucagaacauauacugaauggaaug

SEQ ID NO: 535628 - RNA, 32 nt, Human
uucccagcucagcucaguaccucagccaccuc

SEQ ID NO: 535629 - RNA, 32 nt, Human
uucccagcucccaagcccuguggcacccgcag

SEQ ID NO: 535630 - RNA, 21 nt, Human
uucccagcuccuggccucaca

SEQ ID NO: 535631 - RNA, 21 nt, Human
uucccagcucugaucuccaca

SEQ ID NO: 535632 - RNA, 32 nt, Human
uucccagcucuggcugaccauuuuguucccug

SEQ ID NO: 535633 - RNA, 32 nt, Human
uucccagcugcuguaacggagccaccuccaac

SEQ ID NO: 535634 - RNA, 32 nt, Human
uucccagcugcuuccugcucagcugggccacc

SEQ ID NO: 535635 - RNA, 32 nt, Human
uucccagcuuugauucagaagguacuaguuau

SEQ ID NO: 535636 - RNA, 32 nt, Human
uucccaggaaaccaucuauagagauuugcauu

SEQ ID NO: 535637 - RNA, 32 nt, Human
uucccaggacagcuccaggaucgagaucacug

SEQ ID NO: 535638 - RNA, 22 nt, Human
uucccaggacugcccaaugaca

SEQ ID NO: 535639 - RNA, 32 nt, Human
uucccaggagacugggcugggaacaggaaggg

SEQ ID NO: 535640 - RNA, 32 nt, Human
uucccaggagccaagcagaugucaguaccaug

SEQ ID NO: 535641 - RNA, 22 nt, Human
uucccaggagggagaaagagaa

SEQ ID NO: 535642 - RNA, 18 nt, Human
uucccaggaucugcucca

SEQ ID NO: 535643 - RNA, 32 nt, Human
uucccaggcacccuccuuucugccccagagga

SEQ ID NO: 535644 - RNA, 32 nt, Human
uucccaggcauacacuuccacugccuucagcu

SEQ ID NO: 535645 - RNA, 32 nt, Human
uucccaggccucucuggccacugcuuuguauc

SEQ ID NO: 535646 - RNA, 32 nt, Human
uucccaggcuaaaucacuuaccucccaccccc

SEQ ID NO: 535647 - RNA, 32 nt, Human
uucccaggcucaggcucaggugauccucacac

SEQ ID NO: 535648 - RNA, 32 nt, Human
uucccaggcugaggacaaacccaggacugcuc

SEQ ID NO: 535649 - RNA, 21 nt, Human
uucccaggcuggagugcaaug

SEQ ID NO: 535650 - RNA, 22 nt, Human
uucccaggcuggagugcagugg

SEQ ID NO: 535651 - RNA, 32 nt, Human
uucccagggaucucuucucuccccuucaccau

SEQ ID NO: 535652 - RNA, 32 nt, Human
uucccagggcccugauuuucagcacggaugau

SEQ ID NO: 535653 - RNA, 32 nt, Human
uucccagggcuggagcagguguacccugagca

SEQ ID NO: 535654 - RNA, 32 nt, Human
uucccagggcuuugcccucugugucuuagcag

SEQ ID NO: 535655 - RNA, 21 nt, Human
uucccaggggauugaacagaa

SEQ ID NO: 535656 - RNA, 32 nt, Human
uucccagggggcagaggcaggggcgggagggg

SEQ ID NO: 535657 - RNA, 32 nt, Human
uucccaggguggcgccugcucuccauccaggc

SEQ ID NO: 535658 - RNA, 32 nt, Human
uucccagguacccugcaugcauauagcugcug

SEQ ID NO: 535659 - RNA, 32 nt, Human
uucccagguagcugggauuacaggcaugugcc

SEQ ID NO: 535660 - RNA, 32 nt, Human
uucccaggugucccuaauuugagaaguaaccu

SEQ ID NO: 535661 - RNA, 32 nt, Human
uucccagguuugagcucugcagccucucuccu

SEQ ID NO: 535662 - RNA, 16 nt, Human
uucccaguccacuucu

SEQ ID NO: 535663 - RNA, 18 nt, Human
uucccaguccucuggacu

SEQ ID NO: 535664 - RNA, 32 nt, Human
uucccagucguaugccagcuuggagagucacg

SEQ ID NO: 535665 - RNA, 32 nt, Human
uucccagucugcuugucucccuuucccuugca

SEQ ID NO: 535666 - RNA, 19 nt, Human
uucccagugccuggccgaa

SEQ ID NO: 535667 - RNA, 32 nt, Human
uucccaguggccuucccaccaggaggaaagcc

SEQ ID NO: 535668 - RNA, 32 nt, Human
uucccaguguggcucccagagcuuugaccaga

SEQ ID NO: 535669 - RNA, 32 nt, Human
uucccaguguucugccgcuccuguggccaugu

SEQ ID NO: 535670 - RNA, 32 nt, Human
uucccaguuacaccaggcauccuggcccaaag

SEQ ID NO: 535671 - RNA, 32 nt, Human
uucccaguuccuucccgggccccacacgcugc

SEQ ID NO: 535672 - RNA, 32 nt, Human
uucccaguucugacauucacagcaugaccuag

SEQ ID NO: 535673 - RNA, 32 nt, Human
uucccaguugcugucccuggguccccucuuuc

SEQ ID NO: 535674 - RNA, 32 nt, Human
uucccaguuucuccaagcugcuucuggaaugc

SEQ ID NO: 535675 - RNA, 21 nt, Human
uucccauaauagcuuccagua

SEQ ID NO: 535676 - RNA, 32 nt, Human
uucccauagagaaacccugacuggccgcugag

SEQ ID NO: 535677 - RNA, 32 nt, Human
uucccauauauuucagggucucuguguauuaa

SEQ ID NO: 535678 - RNA, 32 nt, Human
uucccaucacucuuuacaugguggugaugucc

SEQ ID NO: 535679 - RNA, 32 nt, Human
uucccaucaggacugaaggaccuaguccccca

SEQ ID NO: 535680 - RNA, 32 nt, Human
uucccaucagguuaaagacuucaucuagauga

SEQ ID NO: 535681 - RNA, 32 nt, Human
uucccaucaugggaacagugguucuuccccag

SEQ ID NO: 535682 - RNA, 32 nt, Human
uucccaucccacugcucccccaacacaaaccc

SEQ ID NO: 535683 - RNA, 32 nt, Human
uucccauccgcaccagcaagagggccccugug

SEQ ID NO: 535684 - RNA, 32 nt, Human
uucccauccuccagggucucccaaaccagcca

SEQ ID NO: 535685 - RNA, 32 nt, Human
uucccauccugaucccucucccaccagacugg

SEQ ID NO: 535686 - RNA, 32 nt, Human
uucccauccugucacuugcagcagaaacuauu

SEQ ID NO: 535687 - RNA, 32 nt, Human
uucccaucgagucucuggucucugccuucagg

SEQ ID NO: 535688 - RNA, 32 nt, Human
uucccaucggaggugguuggugcagauggaag

SEQ ID NO: 535689 - RNA, 32 nt, Human
uucccaucuacugaaacagggucuccacaaga

SEQ ID NO: 535690 - RNA, 32 nt, Human
uucccaucucauuccaggggcccagagcagca

SEQ ID NO: 535691 - RNA, 32 nt, Human
uucccaucuccaaaaauccagagacauuacga

SEQ ID NO: 535692 - RNA, 32 nt, Human
uucccaucuccauggcaacccaaccaaaccaa

SEQ ID NO: 535693 - RNA, 32 nt, Human
uucccaucucucucugugcccuuagccugcug

SEQ ID NO: 535694 - RNA, 32 nt, Human
uucccaucuuugucucuagccuggagaagagc

SEQ ID NO: 535695 - RNA, 32 nt, Human
uucccaugaaaguuaguaagaugcccuuuuaa

SEQ ID NO: 535696 - RNA, 32 nt, Human
uucccaugaacuggaaagcucaccuccacugc

SEQ ID NO: 535697 - RNA, 32 nt, Human
uucccaugacgcauggcaacacuggauucagu

SEQ ID NO: 535698 - RNA, 32 nt, Human
uucccaugacugcacccagcuccaggggcccu

SEQ ID NO: 535699 - RNA, 30 nt, Human
uucccaugcaaacuguagggcgcuuacagc

SEQ ID NO: 535700 - RNA, 32 nt, Human
uucccaugcauucucuuuccccgggaaaguug

SEQ ID NO: 535701 - RNA, 32 nt, Human
uucccaugcuaagcugagucugugccauagca

SEQ ID NO: 535702 - RNA, 32 nt, Human
uucccauggauaggcgugugacccugguugag

SEQ ID NO: 535703 - RNA, 32 nt, Human
uucccauggcaauuuaaccacauuuggaaggc

SEQ ID NO: 535704 - RNA, 23 nt, Human
uucccauggccuccaggccucua

SEQ ID NO: 535705 - RNA, 32 nt, Human
uucccauggcugcuucauuuguuguucauuuc

SEQ ID NO: 535706 - RNA, 32 nt, Human
uucccauggguggagguggcccagguggucaa

SEQ ID NO: 535707 - RNA, 21 nt, Human
uucccauguccuucuggucuc

SEQ ID NO: 535708 - RNA, 32 nt, Human
uucccaugugaacaagugacccugcuauauuu

SEQ ID NO: 535709 - RNA, 32 nt, Human
uucccauuacgacccuccucuggucauggucc

SEQ ID NO: 535710 - RNA, 32 nt, Human
uucccauuagauucuccacacaaaaagcccua

SEQ ID NO: 535711 - RNA, 32 nt, Human
uucccauuguaaggcuggagcugaaauagucu

SEQ ID NO: 535712 - RNA, 32 nt, Human
uucccauuguuuuaacagcuguguggcugacu

SEQ ID NO: 535713 - RNA, 32 nt, Human
uucccauuugaaauugcuggcgcugcuggccg

SEQ ID NO: 535714 - RNA, 32 nt, Human
uucccauuugacugaugcaugcuaaaguguga

SEQ ID NO: 535715 - RNA, 32 nt, Human
uuccccaaaucuuggcugggcacgguggcuca

SEQ ID NO: 535716 - RNA, 24 nt, Human
uuccccaacacuuccuucccaaca

SEQ ID NO: 535717 - RNA, 32 nt, Human
uuccccaaccacggcccagcccugccacaccc

SEQ ID NO: 535718 - RNA, 32 nt, Human
uuccccaaccucucaguggugagcaggcuuug

SEQ ID NO: 535719 - RNA, 32 nt, Human
uuccccaagcauccagccuggggaugggcccc

SEQ ID NO: 535720 - RNA, 32 nt, Human
uuccccaaggggaaagacuggcuuuguaauua

SEQ ID NO: 535721 - RNA, 32 nt, Human
uuccccaagugcugggauuacaggugugagcc

SEQ ID NO: 535722 - RNA, 32 nt, Human
uuccccaaucccccuucucuucuuccagauua

SEQ ID NO: 535723 - RNA, 32 nt, Human
uuccccaaucccggcccugcugugcugcugcc

SEQ ID NO: 535724 - RNA, 24 nt, Human
uuccccaaucgaugcucucagggu

SEQ ID NO: 535725 - RNA, 22 nt, Human
uuccccaaugcuccaucccaac

SEQ ID NO: 535726 - RNA, 32 nt, Human
uuccccacaagcccccuccaacccccaccccc

SEQ ID NO: 535727 - RNA, 32 nt, Human
uuccccaccaccuccuuagccuggugugagaa

SEQ ID NO: 535728 - RNA, 32 nt, Human
uuccccacccaccccuuccucagcacucugug

SEQ ID NO: 535729 - RNA, 32 nt, Human
uuccccaccccuauuguauuuucuugaacacc

SEQ ID NO: 535730 - RNA, 32 nt, Human
uuccccaccucaccaucucccagacccucuuc

SEQ ID NO: 535731 - RNA, 32 nt, Human
uuccccaccuucagcauaacaggauuuaguaa

SEQ ID NO: 535732 - RNA, 32 nt, Human
uuccccacucacugcagagcugcugccugcca

SEQ ID NO: 535733 - RNA, 32 nt, Human
uuccccacuccccaggccucugaccccaucuc

SEQ ID NO: 535734 - RNA, 32 nt, Human
uuccccacuccguacuguauuuugccauucug

SEQ ID NO: 535735 - RNA, 32 nt, Human
uuccccacuggcacagugggaagcugggauaa

SEQ ID NO: 535736 - RNA, 32 nt, Human
uuccccacuucauuccacccagucucccuccc

SEQ ID NO: 535737 - RNA, 32 nt, Human
uuccccagaauccgcauguuuccccagugauu

SEQ ID NO: 535738 - RNA, 32 nt, Human
uuccccagacacauucuccugugccccucaga

SEQ ID NO: 535739 - RNA, 32 nt, Human
uuccccagauugcaacaggcugggcuucagug

SEQ ID NO: 535740 - RNA, 32 nt, Human
uuccccagauuguuaagaguucacugaagaua

SEQ ID NO: 535741 - RNA, 32 nt, Human
uuccccagcaacaccccuccccgacacaggca

SEQ ID NO: 535742 - RNA, 32 nt, Human
uuccccagcagcugggacuacaggcacgcgcc

SEQ ID NO: 535743 - RNA, 32 nt, Human
uuccccagccacugcugcucauucaaacuucu

SEQ ID NO: 535744 - RNA, 32 nt, Human
uuccccagccucccaccgccccauuugagaua

SEQ ID NO: 535745 - RNA, 32 nt, Human
uuccccagccuccccacugcucccuccucugu

SEQ ID NO: 535746 - RNA, 32 nt, Human
uuccccagcuacuuggaaggcugagaugggaa

SEQ ID NO: 535747 - RNA, 32 nt, Human
uuccccagcuaguaggugacagagcccagauu

SEQ ID NO: 535748 - RNA, 32 nt, Human
uuccccagcuggccuggacugccugugcucug

SEQ ID NO: 535749 - RNA, 32 nt, Human
uuccccaggacuccccucacacaugcacuucc

SEQ ID NO: 535750 - RNA, 22 nt, Human
uuccccaggccggagugcagug

SEQ ID NO: 535751 - RNA, 32 nt, Human
uuccccaggccggagugcagugguacgaucac

SEQ ID NO: 535752 - RNA, 32 nt, Human
uuccccaggcuggacgugguggcucacgccug

SEQ ID NO: 535753 - RNA, 22 nt, Human
uuccccaggcuggagugcaaug

SEQ ID NO: 535754 - RNA, 32 nt, Human
uuccccaggcuggagugcaauggcacgaucuc

SEQ ID NO: 535755 - RNA, 32 nt, Human
uuccccagugagcgcccugccugccuaugcau

SEQ ID NO: 535756 - RNA, 32 nt, Human
uuccccagugggcaugaaagaaaugagggccc

SEQ ID NO: 535757 - RNA, 32 nt, Human
uuccccagugucugaggccacagccaucccuu

SEQ ID NO: 535758 - RNA, 32 nt, Human
uuccccauccacccuccuagcucugcucucag

SEQ ID NO: 535759 - RNA, 32 nt, Human
uuccccauccccaguaguuuacauuccugacu

SEQ ID NO: 535760 - RNA, 32 nt, Human
uuccccaucccccaugcucuugcgugugcuug

SEQ ID NO: 535761 - RNA, 32 nt, Human
uuccccauccucaagcaggagccccagucccc

SEQ ID NO: 535762 - RNA, 32 nt, Human
uuccccaucuaaggaacagauguggucguucc

SEQ ID NO: 535763 - RNA, 32 nt, Human
uuccccaucugcaaaaugaggagggucauagu

SEQ ID NO: 535764 - RNA, 32 nt, Human
uuccccaucugcaaaaugggggugacgauauc

SEQ ID NO: 535765 - RNA, 32 nt, Human
uuccccaucuucuccucuauucuggucucccc

SEQ ID NO: 535766 - RNA, 32 nt, Human
uuccccaucuucuucucucggucccgggagcc

SEQ ID NO: 535767 - RNA, 32 nt, Human
uuccccaugaagaaccagacagcuagaguguc

SEQ ID NO: 535768 - RNA, 32 nt, Human
uuccccaugucauccaggcuggucuggaacuc

SEQ ID NO: 535769 - RNA, 24 nt, Human
uuccccaugucuuucuggcugucu

SEQ ID NO: 535770 - RNA, 32 nt, Human
uuccccauuaaacugggugccuggugaggaca

SEQ ID NO: 535771 - RNA, 32 nt, Human
uuccccauucguucuccggggagggagggacu

SEQ ID NO: 535772 - RNA, 32 nt, Human
uucccccaaagacaggagguguggcugauggg

SEQ ID NO: 535773 - RNA, 32 nt, Human
uucccccaagccugccccucugccucauuuuc

SEQ ID NO: 535774 - RNA, 32 nt, Human
uucccccaauguuugaaagaggcauuaggcuc

SEQ ID NO: 535775 - RNA, 32 nt, Human
uucccccacagcuaucuucacucucugccuuc

SEQ ID NO: 535776 - RNA, 32 nt, Human
uucccccaccccauuucucuccucacacacag

SEQ ID NO: 535777 - RNA, 32 nt, Human
uucccccaccgcaaccuccaucucccggguuc

SEQ ID NO: 535778 - RNA, 32 nt, Human
uucccccacuacugcagcaccuccaggccugu

SEQ ID NO: 535779 - RNA, 32 nt, Human
uucccccacucccauucccuggccucugccau

SEQ ID NO: 535780 - RNA, 19 nt, Human
uucccccacuccccacuga

SEQ ID NO: 535781 - RNA, 32 nt, Human
uucccccacugccccagcucugacuggacccc

SEQ ID NO: 535782 - RNA, 32 nt, Human
uucccccacuggcugcucuacugcuuccccuc

SEQ ID NO: 535783 - RNA, 32 nt, Human
uucccccagaaauuacucaaugcugaaaccuc

SEQ ID NO: 535784 - RNA, 32 nt, Human
uucccccagacuccuggaguucuagucaauuc

SEQ ID NO: 535785 - RNA, 32 nt, Human
uucccccagcacccaggagagccuugcugugu

SEQ ID NO: 535786 - RNA, 32 nt, Human
uucccccagccgggcuggaggcugugcagaag

SEQ ID NO: 535787 - RNA, 32 nt, Human
uucccccagcuaugaggccgaggcgggcuggc

SEQ ID NO: 535788 - RNA, 32 nt, Human
uucccccaggagaauuuuuagucuucuuucau

SEQ ID NO: 535789 - RNA, 22 nt, Human
uucccccagucccucccucuuc

SEQ ID NO: 535790 - RNA, 19 nt, Human
uucccccaucccccacugg

SEQ ID NO: 535791 - RNA, 32 nt, Human
uucccccaucuggugaugcuugagugcacaga

SEQ ID NO: 535792 - RNA, 22 nt, Human
uucccccaucuucaucccaaca

SEQ ID NO: 535793 - RNA, 32 nt, Human
uucccccaugcuguucugauagugagugaguu

SEQ ID NO: 535794 - RNA, 20 nt, Human
uuccccccagucaguauuac

SEQ ID NO: 535795 - RNA, 32 nt, Human
uucccccgcaggccgggcaugggugggggcgc

SEQ ID NO: 535796 - RNA, 32 nt, Human
uucccccgcgccgccuccccgcgccgcucgga

SEQ ID NO: 535797 - RNA, 32 nt, Human
uucccccgcugguuccaccaagcacagucaag

SEQ ID NO: 535798 - RNA, 32 nt, Human
uucccccggggccaugcugccugcagccacag

SEQ ID NO: 535799 - RNA, 32 nt, Human
uucccccuacuucuaauuugcugaaugaagaa

SEQ ID NO: 535800 - RNA, 32 nt, Human
uucccccuaucauuccuuuacagugccuagug

SEQ ID NO: 535801 - RNA, 32 nt, Human
uucccccucacugcaguugucugcauuuuuag

SEQ ID NO: 535802 - RNA, 32 nt, Human
uucccccucccaggccuccugggugucacccc

SEQ ID NO: 535803 - RNA, 32 nt, Human
uucccccucccucauccucccaucccaguaaa

SEQ ID NO: 535804 - RNA, 32 nt, Human
uucccccuccuccccuccuuucuguccucucu

SEQ ID NO: 535805 - RNA, 24 nt, Human
uucccccucucaugguaggccagg

SEQ ID NO: 535806 - RNA, 32 nt, Human
uucccccucucccuccccaauggcuguguagc

SEQ ID NO: 535807 - RNA, 32 nt, Human
uucccccucugcuaugccuuagggaagaugac

SEQ ID NO: 535808 - RNA, 32 nt, Human
uucccccugcacaaggugaggggugggcuggc

SEQ ID NO: 535809 - RNA, 32 nt, Human
uucccccugcagcuacucuucagaucuggcuc

SEQ ID NO: 535810 - RNA, 32 nt, Human
uucccccugcagugcccugcccuugcugcccu

SEQ ID NO: 535811 - RNA, 32 nt, Human
uucccccugcauauugggguugaaaacuuaaa

SEQ ID NO: 535812 - RNA, 32 nt, Human
uucccccugccccaccucucccaccaagaggc

SEQ ID NO: 535813 - RNA, 32 nt, Human
uucccccugccucucuggccucuugucucccc

SEQ ID NO: 535814 - RNA, 32 nt, Human
uucccccugccugugucuucagcccugaugca

SEQ ID NO: 535815 - RNA, 32 nt, Human
uucccccugcuucugccagcagcuccaucuug

SEQ ID NO: 535816 - RNA, 32 nt, Human
uucccccugggugugcagccuauggcuucgug

SEQ ID NO: 535817 - RNA, 32 nt, Human
uucccccuguguaaguuacuaugguuuguggu

SEQ ID NO: 535818 - RNA, 32 nt, Human
uucccccuguguuuucacgcaggucauauugu

SEQ ID NO: 535819 - RNA, 32 nt, Human
uucccccuucacauaaaggaacaugguuuguc

SEQ ID NO: 535820 - RNA, 32 nt, Human
uucccccuuccccugcgcccucccucccucca

SEQ ID NO: 535821 - RNA, 32 nt, Human
uucccccuuccucugggcaggggacagagaga

SEQ ID NO: 535822 - RNA, 32 nt, Human
uuccccgacggggagcacaggagcagcacugc

SEQ ID NO: 535823 - RNA, 32 nt, Human
uuccccgagcacuccagccuggcagucagcac

SEQ ID NO: 535824 - RNA, 32 nt, Human
uuccccgaucagagcuccucugcaggaaacag

SEQ ID NO: 535825 - RNA, 32 nt, Human
uuccccgcaccucgcccugccacugccuccca

SEQ ID NO: 535826 - RNA, 32 nt, Human
uuccccgcaggcucuggcuggccgcaggcugg

SEQ ID NO: 535827 - RNA, 32 nt, Human
uuccccgccaagucccgcaggucucgcagucg

SEQ ID NO: 535828 - RNA, 32 nt, Human
uuccccgcccuguguccauguguucucauugu

SEQ ID NO: 535829 - RNA, 32 nt, Human
uuccccgccugcugcagcuccucccagaaccg

SEQ ID NO: 535830 - RNA, 32 nt, Human
uuccccgcgaggucugggacaagugaagagag

SEQ ID NO: 535831 - RNA, 32 nt, Human
uuccccgcggcaggaagagucucucucugccc

SEQ ID NO: 535832 - RNA, 32 nt, Human
uuccccgcuccugacuccugaccuccaggaug

SEQ ID NO: 535833 - RNA, 32 nt, Human
uuccccggagguugaagcuacagugagccuug

SEQ ID NO: 535834 - RNA, 32 nt, Human
uuccccggccgggagaccaguguuagaggauc

SEQ ID NO: 535835 - RNA, 32 nt, Human
uuccccggcuccacccuaggccacuuuuucua

SEQ ID NO: 535836 - RNA, 32 nt, Human
uuccccgggcugggccacccaucugccuggug

SEQ ID NO: 535837 - RNA, 32 nt, Human
uuccccgggguagaaguccagggugagaaauu

SEQ ID NO: 535838 - RNA, 32 nt, Human
uuccccggucccuugagaccucagccaugagg

SEQ ID NO: 535839 - RNA, 32 nt, Human
uuccccggugagccucaguuccugggcuggac

SEQ ID NO: 535840 - RNA, 32 nt, Human
uuccccgguggagggagggagcagggagcccu

SEQ ID NO: 535841 - RNA, 32 nt, Human
uuccccggugggcucccugguguucggggcug

SEQ ID NO: 535842 - RNA, 32 nt, Human
uuccccggugugagcccggugagggcggcagg

SEQ ID NO: 535843 - RNA, 32 nt, Human
uuccccguggacaugaaggggagggagggugu

SEQ ID NO: 535844 - RNA, 32 nt, Human
uuccccgugguacugagcucacguggacuccc

SEQ ID NO: 535845 - RNA, 32 nt, Human
uuccccgugugggucuagaacuccccuuuggu

SEQ ID NO: 535846 - RNA, 32 nt, Human
uuccccguuccugucacauuuccccagcccca

SEQ ID NO: 535847 - RNA, 31 nt, Human
uuccccguuuugacgacgcacuuguagccac

SEQ ID NO: 535848 - RNA, 22 nt, Human
uuccccuaaugccuucuccugc

SEQ ID NO: 535849 - RNA, 32 nt, Human
uuccccuacaacuaaaaggaaaaggaaacacu

SEQ ID NO: 535850 - RNA, 32 nt, Human
uuccccuacccccaacuuuccccaccagcucc

SEQ ID NO: 535851 - RNA, 32 nt, Human
uuccccuacccuaagcuguagccugggugacu

SEQ ID NO: 535852 - RNA, 24 nt, Human
uuccccuaccucucuuccuucuuc

SEQ ID NO: 535853 - RNA, 32 nt, Human
uuccccucacuccuccccuccuucgcucgcuc

SEQ ID NO: 535854 - RNA, 32 nt, Human
uuccccucacugcacuuuggaccccuggggcc

SEQ ID NO: 535855 - RNA, 32 nt, Human
uuccccucacuuggaggaaccagcacucucca

SEQ ID NO: 535856 - RNA, 24 nt, Human
uuccccucagcuuucccuccucgc

SEQ ID NO: 535857 - RNA, 32 nt, Human
uuccccucauuccuccccuccuucgcucgcuc

SEQ ID NO: 535858 - RNA, 32 nt, Human
uuccccuccagccuggugcugggcuccucggc

SEQ ID NO: 535859 - RNA, 32 nt, Human
uuccccucccggggcccugccggcggcggggc

SEQ ID NO: 535860 - RNA, 32 nt, Human
uuccccucccuauguccauguguucucauugc

SEQ ID NO: 535861 - RNA, 32 nt, Human
uuccccucccuguguccauguguucucauugu

SEQ ID NO: 535862 - RNA, 32 nt, Human
uuccccuccgagggcagagaggcguccgcgcc

SEQ ID NO: 535863 - RNA, 26 nt, Human
uuccccuccgucuuuccccuccccug

SEQ ID NO: 535864 - RNA, 32 nt, Human
uuccccuccucacgccagccuaggagaagaag

SEQ ID NO: 535865 - RNA, 32 nt, Human
uuccccuccuuccaaaaacagccuccaauacc

SEQ ID NO: 535866 - RNA, 32 nt, Human
uuccccuccuuuccuccuccugccccauaaua

SEQ ID NO: 535867 - RNA, 32 nt, Human
uuccccucgcgaucccccuccugccucuucgg

SEQ ID NO: 535868 - RNA, 32 nt, Human
uuccccucuaucugccugaaauaauuuccuaa

SEQ ID NO: 535869 - RNA, 32 nt, Human
uuccccucugagcucugggagggaagggaaug

SEQ ID NO: 535870 - RNA, 32 nt, Human
uuccccucugccauccccuuggggccgguccc

SEQ ID NO: 535871 - RNA, 32 nt, Human
uuccccucugcuacuagccacugagaagugca

SEQ ID NO: 535872 - RNA, 32 nt, Human
uuccccucuggcccagccaccacugccucuca

SEQ ID NO: 535873 - RNA, 32 nt, Human
uuccccucuuuacucccagcaguggcugaaac

SEQ ID NO: 535874 - RNA, 32 nt, Human
uuccccugagcagggucugcugccucagaccc

SEQ ID NO: 535875 - RNA, 32 nt, Human
uuccccugagccugaggggcugcagcugggga

SEQ ID NO: 535876 - RNA, 32 nt, Human
uuccccugcacccacccagcugucuggcccga

SEQ ID NO: 535877 - RNA, 32 nt, Human
uuccccugcaccuggccugggccacaccugag

SEQ ID NO: 535878 - RNA, 24 nt, Human
uuccccugcccuugaucccuucug

SEQ ID NO: 535879 - RNA, 23 nt, Human
uuccccugccugcuccuccaugc

SEQ ID NO: 535880 - RNA, 24 nt, Human
uuccccugcuaucucccuuccugc

SEQ ID NO: 535881 - RNA, 32 nt, Human
uuccccugcuggcugcaagcuguggguucuuu

SEQ ID NO: 535882 - RNA, 19 nt, Human
uuccccugcuguccccuuc

SEQ ID NO: 535883 - RNA, 32 nt, Human
uuccccuggagagucugggauugcacagaaca

SEQ ID NO: 535884 - RNA, 32 nt, Human
uuccccuggccgccuccucugugucauugucu

SEQ ID NO: 535885 - RNA, 29 nt, Human
uuccccuggcugcuguuguaaucuacuug

SEQ ID NO: 535886 - RNA, 29 nt, Human
uuccccuggcugcuucugccuccuaauag

SEQ ID NO: 535887 - RNA, 32 nt, Human
uuccccugggagaggccaggagggccugaucc

SEQ ID NO: 535888 - RNA, 32 nt, Human
uuccccugggcggggcccugcaccgacuccag

SEQ ID NO: 535889 - RNA, 32 nt, Human
uuccccuggggaagcuuugguugaauauuuuc

SEQ ID NO: 535890 - RNA, 21 nt, Human
uuccccuggugugaggccagg

SEQ ID NO: 535891 - RNA, 20 nt, Human
uuccccuguccccacccugc

SEQ ID NO: 535892 - RNA, 22 nt, Human
uuccccuguccccucccccuuc

SEQ ID NO: 535893 - RNA, 23 nt, Human
uuccccuguccugaagccccugu

SEQ ID NO: 535894 - RNA, 32 nt, Human
uuccccuguccugauggucagcucccuucucu

SEQ ID NO: 535895 - RNA, 24 nt, Human
uuccccugucuuucccucuucugc

SEQ ID NO: 535896 - RNA, 32 nt, Human
uuccccugugcugggggccuugagugcuaugc

SEQ ID NO: 535897 - RNA, 32 nt, Human
uuccccuguggcagcuguauguguaguucaau

SEQ ID NO: 535898 - RNA, 20 nt, Human
uuccccuguuaggaaggaug

SEQ ID NO: 535899 - RNA, 21 nt, Human
uuccccuguucucccucuucu

SEQ ID NO: 535900 - RNA, 32 nt, Human
uuccccuuaccuccucucucuggcucgggagc

SEQ ID NO: 535901 - RNA, 32 nt, Human
uuccccuuacucucacaccugggcaaacuuuc

SEQ ID NO: 535902 - RNA, 32 nt, Human
uuccccuucacacccccguggcuggaaggaac

SEQ ID NO: 535903 - RNA, 32 nt, Human
uuccccuuccacccucuccucuuccacccucc

SEQ ID NO: 535904 - RNA, 32 nt, Human
uuccccuucccuucccuucccuuccaucucuu

SEQ ID NO: 535905 - RNA, 32 nt, Human
uuccccuuccuguguccaugugaucucauugu

SEQ ID NO: 535906 - RNA, 32 nt, Human
uuccccuuccuguguccauguguucucauugu

SEQ ID NO: 535907 - RNA, 32 nt, Human
uuccccuuccuuccuuccuuccuuccuuccuu

SEQ ID NO: 535908 - RNA, 32 nt, Human
uuccccuucuccccuguccucaccauaugccu

SEQ ID NO: 535909 - RNA, 32 nt, Human
uuccccuucucccgucagaccuuccugaccuc

SEQ ID NO: 535910 - RNA, 32 nt, Human
uuccccuucucccuccugcuccaggcccaagg

SEQ ID NO: 535911 - RNA, 32 nt, Human
uuccccuucucuucccaggccugggaggggga

SEQ ID NO: 535912 - RNA, 32 nt, Human
uuccccuugcauucuauaagauuacagcaaga

SEQ ID NO: 535913 - RNA, 32 nt, Human
uuccccuugccucacucucucagcuuucuucc

SEQ ID NO: 535914 - RNA, 32 nt, Human
uuccccuugcuguuaccugcugccuucuugug

SEQ ID NO: 535915 - RNA, 32 nt, Human
uuccccuuggcugugucucuuuauuuaugcug

SEQ ID NO: 535916 - RNA, 32 nt, Human
uuccccuugugcaaagagcucuuuuggaccua

SEQ ID NO: 535917 - RNA, 32 nt, Human
uuccccuuuauuucccuuuuccauuuaccccg

SEQ ID NO: 535918 - RNA, 32 nt, Human
uuccccuuugccccugcuucaucccagcucug

SEQ ID NO: 535919 - RNA, 32 nt, Human
uuccccuuugccuucugccaugauucuaaguu

SEQ ID NO: 535920 - RNA, 32 nt, Human
uuccccuuugcuagagcugucucccucucaau

SEQ ID NO: 535921 - RNA, 32 nt, Human
uuccccuuuucccaguccccugcuuuuugaag

SEQ ID NO: 535922 - RNA, 32 nt, Human
uuccccuuuuucucagcacuuccuuuugcugc

SEQ ID NO: 535923 - RNA, 32 nt, Human
uuccccuuuuucugcugccuggcuauuccaug

SEQ ID NO: 535924 - RNA, 32 nt, Human
uucccgaagugcugggauuauaggcguaagcc

SEQ ID NO: 535925 - RNA, 32 nt, Human
uucccgacgagagagacugaggggaagagagg

SEQ ID NO: 535926 - RNA, 32 nt, Human
uucccgacucccugcggcuguguccuuagugc

SEQ ID NO: 535927 - RNA, 22 nt, Human
uucccgacuccugccggaccug

SEQ ID NO: 535928 - RNA, 32 nt, Human
uucccgagacaggcccaugaaaucaugcaggc

SEQ ID NO: 535929 - RNA, 20 nt, Human
uucccgagcacuucggggcc

SEQ ID NO: 535930 - RNA, 32 nt, Human
uucccgagccaucuuuuucuggaacagcgaag

SEQ ID NO: 535931 - RNA, 32 nt, Human
uucccgagcgcuccggccuggcccggcgcccc

SEQ ID NO: 535932 - RNA, 32 nt, Human
uucccgaguagcugggacuacaggcaugugcc

SEQ ID NO: 535933 - RNA, 32 nt, Human
uucccgaguagcugggauuacagaugugcacc

SEQ ID NO: 535934 - RNA, 32 nt, Human
uucccgaguagcugggauuacaggcacacacu

SEQ ID NO: 535935 - RNA, 32 nt, Human
uucccgaguagcugggauuacaggcgccugcc

SEQ ID NO: 535936 - RNA, 32 nt, Human
uucccgaguagcugggauuacaggcgugcgcc

SEQ ID NO: 535937 - RNA, 32 nt, Human
uucccgaguagcugggauuacagguaugaacc

SEQ ID NO: 535938 - RNA, 32 nt, Human
uucccgaguagcugggauuauaggcacacacc

SEQ ID NO: 535939 - RNA, 32 nt, Human
uucccgaguagcugggauuauaggcacccacc

SEQ ID NO: 535940 - RNA, 32 nt, Human
uucccgauaucucacuguccagucccuucauu

SEQ ID NO: 535941 - RNA, 32 nt, Human
uucccgaucuggcugcaucagcauccugguug

SEQ ID NO: 535942 - RNA, 32 nt, Human
uucccgaugucucuucccucugaggccaguag

SEQ ID NO: 535943 - RNA, 32 nt, Human
uucccgcaacacaaguggagagagagguggcc

SEQ ID NO: 535944 - RNA, 32 nt, Human
uucccgcaaucucccuuccaaaucagucacug

SEQ ID NO: 535945 - RNA, 32 nt, Human
uucccgcacucuauucccccagccucuuucug

SEQ ID NO: 535946 - RNA, 32 nt, Human
uucccgcagccuggcuccuguguucccucuau

SEQ ID NO: 535947 - RNA, 32 nt, Human
uucccgcagggugcuggaggaggaaaccggcg

SEQ ID NO: 535948 - RNA, 32 nt, Human
uucccgccuagacucggcgcagggccccgcac

SEQ ID NO: 535949 - RNA, 32 nt, Human
uucccgccuccaggaagggcccuggcucccuu

SEQ ID NO: 535950 - RNA, 32 nt, Human
uucccgccuccccucccgcuugcuuuugccuu

SEQ ID NO: 535951 - RNA, 32 nt, Human
uucccgcggccugcuccgccagccggggucgg

SEQ ID NO: 535952 - RNA, 32 nt, Human
uucccgcguaggcucccaggggccccagggag

SEQ ID NO: 535953 - RNA, 32 nt, Human
uucccgcucgcccggcgccauggauccgcugu

SEQ ID NO: 535954 - RNA, 32 nt, Human
uucccgcugcagcuaucgcgcagucccuccug

SEQ ID NO: 535955 - RNA, 32 nt, Human
uucccgcugccuggcugccuccguggcgguug

SEQ ID NO: 535956 - RNA, 32 nt, Human
uucccgcugguguggagggaaaugcccugguc

SEQ ID NO: 535957 - RNA, 32 nt, Human
uucccgcuugcaggaauggaauccaaacaccu

SEQ ID NO: 535958 - RNA, 32 nt, Human
uucccggaaaguacuaaauuuaagaauguuug

SEQ ID NO: 535959 - RNA, 32 nt, Human
uucccggacugcacuaggcugggagcucuguu

SEQ ID NO: 535960 - RNA, 32 nt, Human
uucccggagccccuugccaauccugacagguc

SEQ ID NO: 535961 - RNA, 32 nt, Human
uucccggagucucccagcugaaauggaagugc

SEQ ID NO: 535962 - RNA, 32 nt, Human
uucccggcaguuuuugccuuaaagcugcccuc

SEQ ID NO: 535963 - RNA, 32 nt, Human
uucccggcucaaguccuuccucucucuuuccu

SEQ ID NO: 535964 - RNA, 21 nt, Human
uucccggcuccgugggaaccu

SEQ ID NO: 535965 - RNA, 32 nt, Human
uucccgggaaguuguuuggugaaggaagcccc

SEQ ID NO: 535966 - RNA, 32 nt, Human
uucccgggaucacuuaaugaaccacguguuuu

SEQ ID NO: 535967 - RNA, 32 nt, Human
uucccggggaaagggaaaagggaccauaggcc

SEQ ID NO: 535968 - RNA, 32 nt, Human
uucccggguggccaguggcucagcagucucgg

SEQ ID NO: 535969 - RNA, 32 nt, Human
uucccggguuuguccugagccugcacuguccu

SEQ ID NO: 535970 - RNA, 32 nt, Human
uucccggucccccagcccauccgccaucccca

SEQ ID NO: 535971 - RNA, 32 nt, Human
uucccggucuguucuguuccacucugaccauc

SEQ ID NO: 535972 - RNA, 32 nt, Human
uucccggugaagccucaccuucaagccaagaa

SEQ ID NO: 535973 - RNA, 32 nt, Human
uucccguaauuacuuauugcaguauuguguuc

SEQ ID NO: 535974 - RNA, 32 nt, Human
uucccguccccuucacugauuucuguuguuuc

SEQ ID NO: 535975 - RNA, 31 nt, Human
uucccguccguacuggaggcuagcucuuguc

SEQ ID NO: 535976 - RNA, 32 nt, Human
uucccgucuccccgucccuccgucuccauccc

SEQ ID NO: 535977 - RNA, 32 nt, Human
uucccgucuccucccuugcuccccuuccucac

SEQ ID NO: 535978 - RNA, 32 nt, Human
uucccguggaguguggggaagcugcugucucc

SEQ ID NO: 535979 - RNA, 32 nt, Human
uucccguggucuccuugcacuuucucaguuca

SEQ ID NO: 535980 - RNA, 32 nt, Human
uucccgugucugucugucuugcaucccuagcc

SEQ ID NO: 535981 - RNA, 32 nt, Human
uucccgugucuguggucaccauuuaggugauc

SEQ ID NO: 535982 - RNA, 32 nt, Human
uucccuaaaauacauuuaaaacuuaccuaagu

SEQ ID NO: 535983 - RNA, 32 nt, Human
uucccuaagaaagagcugaaaugacugagaac

SEQ ID NO: 535984 - RNA, 32 nt, Human
uucccuaagaagggaaaaagagagggaagaac

SEQ ID NO: 535985 - RNA, 32 nt, Human
uucccuaagccaagcuccccaggcccagcuca

SEQ ID NO: 535986 - RNA, 32 nt, Human
uucccuaaggggcagguccagagcagggccca

SEQ ID NO: 535987 - RNA, 32 nt, Human
uucccuaaggggccccagccaaggagcugagc

SEQ ID NO: 535988 - RNA, 32 nt, Human
uucccuaccugacacagccauggcccagcccc

SEQ ID NO: 535989 - RNA, 32 nt, Human
uucccuacgcuuuucccugccuaggccucgug

SEQ ID NO: 535990 - RNA, 32 nt, Human
uucccuacucaggcuuucguagugauuagcuu

SEQ ID NO: 535991 - RNA, 32 nt, Human
uucccuacuuccuaaacucucuuccagcaucg

SEQ ID NO: 535992 - RNA, 32 nt, Human
uucccuagaaauccucuccagcauucuugcca

SEQ ID NO: 535993 - RNA, 32 nt, Human
uucccuagacaccuccggggucccuaccugga

SEQ ID NO: 535994 - RNA, 32 nt, Human
uucccuagagucauuuuugaaaccacugauug

SEQ ID NO: 535995 - RNA, 19 nt, Human
uucccuagcucucugcacu

SEQ ID NO: 535996 - RNA, 23 nt, Human
uucccuagcugugcagcugcaag

SEQ ID NO: 535997 - RNA, 32 nt, Human
uucccuagcugugccauuuggugcucugccag

SEQ ID NO: 535998 - RNA, 32 nt, Human
uucccuaggccugcuggcucugguuuucuaug

SEQ ID NO: 535999 - RNA, 32 nt, Human
uucccuagucacagagcagcugugaugggacc

SEQ ID NO: 536000 - RNA, 32 nt, Human
uucccuaguuuauaagacaggagaaaagggag

SEQ ID NO: 536001 - RNA, 32 nt, Human
uucccuaucuuggaccugaggcugcuuucuug

SEQ ID NO: 536002 - RNA, 32 nt, Human
uucccuaugcagagacaggagagaggucuugu

SEQ ID NO: 536003 - RNA, 31 nt, Human
uucccuauggcagaaggcaaccacagaaaaa

SEQ ID NO: 536004 - RNA, 32 nt, Human
uucccuauuacugcuaguaugcuacuucuuac

SEQ ID NO: 536005 - RNA, 32 nt, Human
uucccuauucagcagcauuuuaaucacauguc

SEQ ID NO: 536006 - RNA, 32 nt, Human
uucccuauucaggugaggggaucaauagaaac

SEQ ID NO: 536007 - RNA, 22 nt, Human
uucccuauuuacaccucagggu

SEQ ID NO: 536008 - RNA, 32 nt, Human
uucccucaaaaacaaagaacuaaaggcaagca

SEQ ID NO: 536009 - RNA, 32 nt, Human
uucccucacucaggaacucuguuucugaaguc

SEQ ID NO: 536010 - RNA, 32 nt, Human
uucccucagcaaccuguguguucaaagguuag

SEQ ID NO: 536011 - RNA, 32 nt, Human
uucccucagcuuuguacaucagcacuguuuug

SEQ ID NO: 536012 - RNA, 32 nt, Human
uucccucagugauuucaggaacugacaauucc

SEQ ID NO: 536013 - RNA, 32 nt, Human
uucccucauccagcagcuggcaucugaccuug

SEQ ID NO: 536014 - RNA, 32 nt, Human
uucccucaugccaacugcagugaucuaggcac

SEQ ID NO: 536015 - RNA, 32 nt, Human
uucccucauucccgcugaccucacuggcccac

SEQ ID NO: 536016 - RNA, 32 nt, Human
uucccucauucguguugcuggaacuggagcac

SEQ ID NO: 536017 - RNA, 32 nt, Human
uucccuccaaacugcugacuaggucauccucu

SEQ ID NO: 536018 - RNA, 32 nt, Human
uucccuccacaagagauauaccaccuuuaaaa

SEQ ID NO: 536019 - RNA, 32 nt, Human
uucccuccacagacaauguccucuguucaauu

SEQ ID NO: 536020 - RNA, 32 nt, Human
uucccuccacccaggccagcagccgucagagc

SEQ ID NO: 536021 - RNA, 32 nt, Human
uucccuccacggcccaggucuccucacucaaa

SEQ ID NO: 536022 - RNA, 32 nt, Human
uucccuccagccgccgccguccagccgagucc

SEQ ID NO: 536023 - RNA, 32 nt, Human
uucccuccagccugggcaauagagcaagaugc

SEQ ID NO: 536024 - RNA, 20 nt, Human
uucccuccaggggcauccag

SEQ ID NO: 536025 - RNA, 32 nt, Human
uucccuccagucagggccaggcguggacgccg

SEQ ID NO: 536026 - RNA, 32 nt, Human
uucccuccaucuaacauucaaauuuaacuauc

SEQ ID NO: 536027 - RNA, 32 nt, Human
uucccuccaugcaccaucacuguggcuggcag

SEQ ID NO: 536028 - RNA, 32 nt, Human
uucccuccauucugugggacagucugucauuu

SEQ ID NO: 536029 - RNA, 32 nt, Human
uucccuccauuuuucucccaagaaaccugacu

SEQ ID NO: 536030 - RNA, 21 nt, Human
uucccucccagugaauggaau

SEQ ID NO: 536031 - RNA, 32 nt, Human
uucccuccccaaguuugcuauucaaaucaacu

SEQ ID NO: 536032 - RNA, 21 nt, Human
uucccuccccacccaccaccu

SEQ ID NO: 536033 - RNA, 19 nt, Human
uucccucccccugccgagg

SEQ ID NO: 536034 - RNA, 32 nt, Human
uucccuccccuccccuuccuguccuuucacaa

SEQ ID NO: 536035 - RNA, 32 nt, Human
uucccucccuccaguauugcccccucucacuu

SEQ ID NO: 536036 - RNA, 32 nt, Human
uucccucccucccucucuccccagcugccucc

SEQ ID NO: 536037 - RNA, 32 nt, Human
uucccucccugccucccccagcucccacacug

SEQ ID NO: 536038 - RNA, 32 nt, Human
uucccucccuuccuccuucucuccuucucucc

SEQ ID NO: 536039 - RNA, 32 nt, Human
uucccucccuuuccuuuuccuauguacuuccu

SEQ ID NO: 536040 - RNA, 32 nt, Human
uucccucccuuucuuuuucuuacuagugcacu

SEQ ID NO: 536041 - RNA, 32 nt, Human
uucccuccgggauccccugccuggugcccaca

SEQ ID NO: 536042 - RNA, 32 nt, Human
uucccuccgggguccagggaggagaacagaaa

SEQ ID NO: 536043 - RNA, 32 nt, Human
uucccuccuaccacugcuuugacuguaccugu

SEQ ID NO: 536044 - RNA, 32 nt, Human
uucccuccucacaucccucccacccucgguca

SEQ ID NO: 536045 - RNA, 32 nt, Human
uucccuccuccccugucucuggcugucucgag

SEQ ID NO: 536046 - RNA, 32 nt, Human
uucccuccuccccuuucuccccuccguccccg

SEQ ID NO: 536047 - RNA, 32 nt, Human
uucccuccugcuccccagagacugccuccgcc

SEQ ID NO: 536048 - RNA, 21 nt, Human
uucccuccuuccaguguuccu

SEQ ID NO: 536049 - RNA, 32 nt, Human
uucccuccuugcacagaugcauacacuggggc

SEQ ID NO: 536050 - RNA, 32 nt, Human
uucccucgccuuccuguuccuggcggagccgg

SEQ ID NO: 536051 - RNA, 32 nt, Human
uucccucuaacccacaccaccuuucuacucac

SEQ ID NO: 536052 - RNA, 32 nt, Human
uucccucuaccucccccaguuagugacaggau

SEQ ID NO: 536053 - RNA, 32 nt, Human
uucccucucauuuugaccuacucucaugcugc

SEQ ID NO: 536054 - RNA, 32 nt, Human
uucccucuccacccguucugccucagugguuu

SEQ ID NO: 536055 - RNA, 32 nt, Human
uucccucucccagauugguggggagggagggc

SEQ ID NO: 536056 - RNA, 32 nt, Human
uucccucucccucccucucuucccauucuccu

SEQ ID NO: 536057 - RNA, 32 nt, Human
uucccucucccuucuuccccaccaacaaaacc

SEQ ID NO: 536058 - RNA, 32 nt, Human
uucccucuccuuccacaccacacuuacuguag

SEQ ID NO: 536059 - RNA, 18 nt, Human
uucccucucuccagggca

SEQ ID NO: 536060 - RNA, 32 nt, Human
uucccucucugacccaggcugaguccauacug

SEQ ID NO: 536061 - RNA, 32 nt, Human
uucccucucuggcguccccggcugcuuguacu

SEQ ID NO: 536062 - RNA, 32 nt, Human
uucccucucuuaucccugaggguggguaagaa

SEQ ID NO: 536063 - RNA, 32 nt, Human
uucccucugagcuacuuccugggcauaguuac

SEQ ID NO: 536064 - RNA, 32 nt, Human
uucccucugcccaggugggggccguggcugga

SEQ ID NO: 536065 - RNA, 32 nt, Human
uucccucugccucugucuccccacaucguccc

SEQ ID NO: 536066 - RNA, 21 nt, Human
uucccucugcuguggguucug

SEQ ID NO: 536067 - RNA, 32 nt, Human
uucccucugggagccuaaaccaggcugcaucg

SEQ ID NO: 536068 - RNA, 32 nt, Human
uucccucugggagucucauggguccagcauca

SEQ ID NO: 536069 - RNA, 32 nt, Human
uucccucugggcagaggcccaucugcucuguu

SEQ ID NO: 536070 - RNA, 32 nt, Human
uucccucugucgcccaggcuagagugcaaugg

SEQ ID NO: 536071 - RNA, 32 nt, Human
uucccucuuccucucauugagggugaugacaa

SEQ ID NO: 536072 - RNA, 32 nt, Human
uucccucuuccucuuuaccuuuccugguccug

SEQ ID NO: 536073 - RNA, 32 nt, Human
uucccucuuccuucccugcugugaaagaagua

SEQ ID NO: 536074 - RNA, 32 nt, Human
uucccucuugucucccugaaaucuacccacuc

SEQ ID NO: 536075 - RNA, 32 nt, Human
uucccucuuucuccucccucuccuccucucac

SEQ ID NO: 536076 - RNA, 32 nt, Human
uucccucuuuucccaucucauucuucccucuu

SEQ ID NO: 536077 - RNA, 32 nt, Human
uucccugacaucagagguaagagcaucuggaa

SEQ ID NO: 536078 - RNA, 32 nt, Human
uucccugacauucuucuaccuaacccacugcu

SEQ ID NO: 536079 - RNA, 32 nt, Human
uucccugaccauugucugcugugugcucccga

SEQ ID NO: 536080 - RNA, 21 nt, Human
uucccugaccuggagaggguu

SEQ ID NO: 536081 - RNA, 32 nt, Human
uucccugacuccaggccugaaccccucccgug

SEQ ID NO: 536082 - RNA, 23 nt, Human
uucccugacuuaaaccucacuga

SEQ ID NO: 536083 - RNA, 32 nt, Human
uucccugagaaaggagaaaaagaugggauugc

SEQ ID NO: 536084 - RNA, 32 nt, Human
uucccugagagaaguagcacucagguuagcaa

SEQ ID NO: 536085 - RNA, 32 nt, Human
uucccugagcucacccagccccagcuccagga

SEQ ID NO: 536086 - RNA, 32 nt, Human
uucccugaggagcugggacaugcugggcaguu

SEQ ID NO: 536087 - RNA, 32 nt, Human
uucccugaggccucuggacccaucugucuucc

SEQ ID NO: 536088 - RNA, 32 nt, Human
uucccugagucucaagagcucuugccuuaccc

SEQ ID NO: 536089 - RNA, 32 nt, Human
uucccugcaacaucuccaccucccaauagucu

SEQ ID NO: 536090 - RNA, 32 nt, Human
uucccugcaaggugcaccugccccaggcucag

SEQ ID NO: 536091 - RNA, 32 nt, Human
uucccugcaccacucucuucauccugggggcu

SEQ ID NO: 536092 - RNA, 32 nt, Human
uucccugcagaucuccagcccagaaccaucuu

SEQ ID NO: 536093 - RNA, 19 nt, Human
uucccugcagccccuggcc

SEQ ID NO: 536094 - RNA, 32 nt, Human
uucccugcagcugcaaccugcccucugguccc

SEQ ID NO: 536095 - RNA, 32 nt, Human
uucccugccaccuccagccucugccagcaaug

SEQ ID NO: 536096 - RNA, 32 nt, Human
uucccugccaucucaaagaggagcaauguauc

SEQ ID NO: 536097 - RNA, 32 nt, Human
uucccugcccaaacccuuaacugacaugggcc

SEQ ID NO: 536098 - RNA, 32 nt, Human
uucccugcccacccuguccccuacaauuugug

SEQ ID NO: 536099 - RNA, 32 nt, Human
uucccugcccagcuuucgggaucucuggcccc

SEQ ID NO: 536100 - RNA, 32 nt, Human
uucccugccccuggucuggucucccccaaaag

SEQ ID NO: 536101 - RNA, 32 nt, Human
uucccugcccuuucccccuccucagguucuuc

SEQ ID NO: 536102 - RNA, 32 nt, Human
uucccugcccuuucugagcucuuccuuccuua

SEQ ID NO: 536103 - RNA, 32 nt, Human
uucccugccuaggagcuggggagggagagauc

SEQ ID NO: 536104 - RNA, 32 nt, Human
uucccugccucccccaggccucaggcccagca

SEQ ID NO: 536105 - RNA, 32 nt, Human
uucccugccucccuuuuucaucaauugcaaug

SEQ ID NO: 536106 - RNA, 32 nt, Human
uucccugccugagacacguauggaagccaaga

SEQ ID NO: 536107 - RNA, 32 nt, Human
uucccugccugccucccucccccugcuagaag

SEQ ID NO: 536108 - RNA, 32 nt, Human
uucccugccuggggcgggccccucaucgcguc

SEQ ID NO: 536109 - RNA, 32 nt, Human
uucccugcgcucacaaaaaccuggugaggguc

SEQ ID NO: 536110 - RNA, 17 nt, Human
uucccugcggcccagag

SEQ ID NO: 536111 - RNA, 32 nt, Human
uucccugcguggaggaagcccacccagcaagc

SEQ ID NO: 536112 - RNA, 32 nt, Human
uucccugcuagccucagccuccauugugguau

SEQ ID NO: 536113 - RNA, 32 nt, Human
uucccugcugacuuggccacggaaacugguuc

SEQ ID NO: 536114 - RNA, 32 nt, Human
uucccugcugcugaguggagagaggccucauc

SEQ ID NO: 536115 - RNA, 32 nt, Human
uucccuggaacaaggaggugggggcagugugg

SEQ ID NO: 536116 - RNA, 32 nt, Human
uucccuggaaguggcagcagcagugagcaguc

SEQ ID NO: 536117 - RNA, 32 nt, Human
uucccuggaaugggacaggcagcucuagucag

SEQ ID NO: 536118 - RNA, 32 nt, Human
uucccuggacaggcagccuccuuuguguguau

SEQ ID NO: 536119 - RNA, 32 nt, Human
uucccuggacuaccuucaggaggcacgagagc

SEQ ID NO: 536120 - RNA, 32 nt, Human
uucccuggaggccacagaggagcaccaaggag

SEQ ID NO: 536121 - RNA, 16 nt, Human
uucccuggaggccagg

SEQ ID NO: 536122 - RNA, 32 nt, Human
uucccuggaucacuccacaguccucaggcuuc

SEQ ID NO: 536123 - RNA, 31 nt, Human
uucccuggcaguaccaccaugccaggcguca

SEQ ID NO: 536124 - RNA, 32 nt, Human
uucccuggccagaugccugaucagaugagaag

SEQ ID NO: 536125 - RNA, 32 nt, Human
uucccuggcccugcaggcuccugcugcaccgc

SEQ ID NO: 536126 - RNA, 32 nt, Human
uucccuggccuuucauauuuuagcuacuauau

SEQ ID NO: 536127 - RNA, 32 nt, Human
uucccuggcgcugcucccaaagauuucugacu

SEQ ID NO: 536128 - RNA, 32 nt, Human
uucccuggcuagucugugccuggucaccaggg

SEQ ID NO: 536129 - RNA, 32 nt, Human
uucccuggcuccaagggcccauuuccuccuag

SEQ ID NO: 536130 - RNA, 23 nt, Human
uucccuggcucuaccucuucugc

SEQ ID NO: 536131 - RNA, 20 nt, Human
uucccuggcucugaaggggu

SEQ ID NO: 536132 - RNA, 32 nt, Human
uucccuggcuucuuucuuucccucucucuuuc

SEQ ID NO: 536133 - RNA, 32 nt, Human
uucccugggacgguggcacagauggaagaaaa

SEQ ID NO: 536134 - RNA, 32 nt, Human
uucccugggagaagacguaucaaaagggaugg

SEQ ID NO: 536135 - RNA, 32 nt, Human
uucccugggaggaucuggagguuguucucugc

SEQ ID NO: 536136 - RNA, 32 nt, Human
uucccugggcuggucuucccuuguacaucgau

SEQ ID NO: 536137 - RNA, 32 nt, Human
uucccuggggaaugucagguuuugaaaaucuc

SEQ ID NO: 536138 - RNA, 32 nt, Human
uucccuggggagcccuuucuuaccuucuuuac

SEQ ID NO: 536139 - RNA, 32 nt, Human
uucccugggggaagucuguucuuugguaugga

SEQ ID NO: 536140 - RNA, 32 nt, Human
uucccuggguccauuucaaagcgcaaacugug

SEQ ID NO: 536141 - RNA, 32 nt, Human
uucccuggguccauuucaaagugcaaacugug

SEQ ID NO: 536142 - RNA, 32 nt, Human
uucccuggguugccucuuuucugccauguggg

SEQ ID NO: 536143 - RNA, 24 nt, Human
uucccugguacugugaaagaguca

SEQ ID NO: 536144 - RNA, 32 nt, Human
uucccuggucucaguucacaagccucaccugu

SEQ ID NO: 536145 - RNA, 22 nt, Human
uucccuggugccaaaaaggguu

SEQ ID NO: 536146 - RNA, 32 nt, Human
uucccuggugugggugaggaugugguuuagga

SEQ ID NO: 536147 - RNA, 32 nt, Human
uucccugguguuagacgcgcucucccuccuuc

SEQ ID NO: 536148 - RNA, 22 nt, Human
uucccugguuaagaaaugaccu

SEQ ID NO: 536149 - RNA, 32 nt, Human
uucccugguucugugagccucugccuuuuccu

SEQ ID NO: 536150 - RNA, 32 nt, Human
uucccugguuugagacucacuuccucaucucc

SEQ ID NO: 536151 - RNA, 32 nt, Human
uucccugguuuucugucacuggcacaggaggg

SEQ ID NO: 536152 - RNA, 32 nt, Human
uucccuguaugguuguccucuggccauugaga

SEQ ID NO: 536153 - RNA, 32 nt, Human
uucccugucuacugcucaggcucucccacuuc

SEQ ID NO: 536154 - RNA, 32 nt, Human
uucccugucuccauucucuagcacgugaaauc

SEQ ID NO: 536155 - RNA, 32 nt, Human
uucccugucuugugugcuucgcgagguagagc

SEQ ID NO: 536156 - RNA, 32 nt, Human
uucccugugcaacaucagauuugcaggaaaaa

SEQ ID NO: 536157 - RNA, 32 nt, Human
uucccugugcaaucuucccuugcccauggucu

SEQ ID NO: 536158 - RNA, 32 nt, Human
uucccugugccuccucccucccucccgacuca

SEQ ID NO: 536159 - RNA, 19 nt, Human
uucccugugcuaucuucca

SEQ ID NO: 536160 - RNA, 32 nt, Human
uucccugugggauguugggcagucucuguugu

SEQ ID NO: 536161 - RNA, 32 nt, Human
uucccuguggucagcuccuuccccaccuuuua

SEQ ID NO: 536162 - RNA, 32 nt, Human
uucccuguuccuucugggucaggcugucacuu

SEQ ID NO: 536163 - RNA, 32 nt, Human
uucccuguucuucuguuucucacacacuuucu

SEQ ID NO: 536164 - RNA, 32 nt, Human
uucccuuacccauguuaucauuuccuuucuau

SEQ ID NO: 536165 - RNA, 32 nt, Human
uucccuuacugagcuugcugagcuccggggcc

SEQ ID NO: 536166 - RNA, 32 nt, Human
uucccuuacuucuccccuuccccucccccucc

SEQ ID NO: 536167 - RNA, 32 nt, Human
uucccuuagccaucuuucuuaugcuuucuuug

SEQ ID NO: 536168 - RNA, 32 nt, Human
uucccuuaguuucuuuucauaaaguaaguuau

SEQ ID NO: 536169 - RNA, 32 nt, Human
uucccuuaucuguuuucuaccuccuccuuugu

SEQ ID NO: 536170 - RNA, 32 nt, Human
uucccuuaugccagguuccagucuugagagga

SEQ ID NO: 536171 - RNA, 32 nt, Human
uucccuucaaaacccagccucuugcaagaagc

SEQ ID NO: 536172 - RNA, 32 nt, Human
uucccuucaagcaucucccucauccuggacuc

SEQ ID NO: 536173 - RNA, 32 nt, Human
uucccuucaagugugaaggaaggugugaugaa

SEQ ID NO: 536174 - RNA, 32 nt, Human
uucccuucagcccauucccccucgguuuuauc

SEQ ID NO: 536175 - RNA, 20 nt, Human
uucccuucauccugcuuaau

SEQ ID NO: 536176 - RNA, 32 nt, Human
uucccuucauuucccccuccuuugcuggaugg

SEQ ID NO: 536177 - RNA, 32 nt, Human
uucccuuccacaggcugguugcaugugccaug

SEQ ID NO: 536178 - RNA, 32 nt, Human
uucccuuccaucucccccuccucccugccuuc

SEQ ID NO: 536179 - RNA, 32 nt, Human
uucccuucccacccucuugucuucagggaauu

SEQ ID NO: 536180 - RNA, 32 nt, Human
uucccuucccacucgcugcuucccacagggug

SEQ ID NO: 536181 - RNA, 32 nt, Human
uucccuuccccagggcccccaagggugucuca

SEQ ID NO: 536182 - RNA, 32 nt, Human
uucccuuccccugugacuccucccuuccccac

SEQ ID NO: 536183 - RNA, 32 nt, Human
uucccuucccuucccuucccuuuccuuuuccc

SEQ ID NO: 536184 - RNA, 32 nt, Human
uucccuucccuuccuuucccuucccuagccag

SEQ ID NO: 536185 - RNA, 32 nt, Human
uucccuuccguucacucauuccuuccuuuccu

SEQ ID NO: 536186 - RNA, 32 nt, Human
uucccuuccuccgccuuccucucccucuccug

SEQ ID NO: 536187 - RNA, 32 nt, Human
uucccuuccucucucucaccuucaccacccaa

SEQ ID NO: 536188 - RNA, 32 nt, Human
uucccuuccucuuccugcccuugaacccccuc

SEQ ID NO: 536189 - RNA, 32 nt, Human
uucccuuccuucugcccugccugccucccugc

SEQ ID NO: 536190 - RNA, 32 nt, Human
uucccuuccuuuccuuucucaggccuugcucc

SEQ ID NO: 536191 - RNA, 32 nt, Human
uucccuucuacccucuauucucuugugucugu

SEQ ID NO: 536192 - RNA, 32 nt, Human
uucccuucucaucaucuucaucucagcuauua

SEQ ID NO: 536193 - RNA, 32 nt, Human
uucccuucucccaccuucuacugggcauaauu

SEQ ID NO: 536194 - RNA, 20 nt, Human
uucccuucucccucgcuguu

SEQ ID NO: 536195 - RNA, 32 nt, Human
uucccuucucggugcccuccucucuuuccuca

SEQ ID NO: 536196 - RNA, 32 nt, Human
uucccuucuggugugucuguugaucuguguuu

SEQ ID NO: 536197 - RNA, 32 nt, Human
uucccuucuucaaauccucccacccuucaaug

SEQ ID NO: 536198 - RNA, 32 nt, Human
uucccuucuuuaucaucuccccuuuccucucc

SEQ ID NO: 536199 - RNA, 32 nt, Human
uucccuugaacugccuugucuuugucauggaa

SEQ ID NO: 536200 - RNA, 32 nt, Human
uucccuugaggaaacaacagcuuuaaaagaaa

SEQ ID NO: 536201 - RNA, 32 nt, Human
uucccuugcaggagaagagggaagugaaaaga

SEQ ID NO: 536202 - RNA, 32 nt, Human
uucccuugcaucuucgcagacauuuccgaccc

SEQ ID NO: 536203 - RNA, 32 nt, Human
uucccuugccuaucccuaccucccuccuacua

SEQ ID NO: 536204 - RNA, 31 nt, Human
uucccuugccucuccuggauggguugucagc

SEQ ID NO: 536205 - RNA, 32 nt, Human
uucccuugccuucuuggacuucuugaaaucaa

SEQ ID NO: 536206 - RNA, 32 nt, Human
uucccuugcuccucuuucuuccuuuucuuuuc

SEQ ID NO: 536207 - RNA, 32 nt, Human
uucccuuggagaaggaccaauggggaauggca

SEQ ID NO: 536208 - RNA, 32 nt, Human
uucccuuguaucaagacaccuuccucagcuuc

SEQ ID NO: 536209 - RNA, 18 nt, Human
uucccuuguccggaggau

SEQ ID NO: 536210 - RNA, 32 nt, Human
uucccuuguuuuuauauugggagugaaaagau

SEQ ID NO: 536211 - RNA, 24 nt, Human
uucccuuuaguagaaccucacuaa

SEQ ID NO: 536212 - RNA, 32 nt, Human
uucccuuuauuuccuuuaccuuuuguuuuucc

SEQ ID NO: 536213 - RNA, 22 nt, Human
uucccuuuccccucagcuuacu

SEQ ID NO: 536214 - RNA, 23 nt, Human
uucccuuuccccucagcuuacuu

SEQ ID NO: 536215 - RNA, 32 nt, Human
uucccuuuccccucagcuuacuuacucccaga

SEQ ID NO: 536216 - RNA, 32 nt, Human
uucccuuucccuuucuuuucuuucuuuacuuu

SEQ ID NO: 536217 - RNA, 32 nt, Human
uucccuuuccuccaaaccccuaacucccucca

SEQ ID NO: 536218 - RNA, 32 nt, Human
uucccuuucuccccuuccaccugcugcgggcu

SEQ ID NO: 536219 - RNA, 32 nt, Human
uucccuuucuuauucccagaagagcucagaga

SEQ ID NO: 536220 - RNA, 32 nt, Human
uucccuuucuucuuuccuuuuuguuuuugugu

SEQ ID NO: 536221 - RNA, 32 nt, Human
uucccuuucuuuccuuuuucccuguccuuuuc

SEQ ID NO: 536222 - RNA, 32 nt, Human
uucccuuugcccacccugcccucucucccucu

SEQ ID NO: 536223 - RNA, 32 nt, Human
uucccuuugccuccuccagcucauuuuucaca

SEQ ID NO: 536224 - RNA, 32 nt, Human
uucccuuugccuucccuucuucccacaaaaga

SEQ ID NO: 536225 - RNA, 21 nt, Human
uucccuuuggacaguguuaca

SEQ ID NO: 536226 - RNA, 32 nt, Human
uucccuuuggccucccccuuuacccagcucuu

SEQ ID NO: 536227 - RNA, 32 nt, Human
uucccuuugguacagaccucuugucagugcua

SEQ ID NO: 536228 - RNA, 32 nt, Human
uucccuuuuccaagccuuccccaaccuccccc

SEQ ID NO: 536229 - RNA, 32 nt, Human
uuccgaaaguggugggauuacaagcaugagcc

SEQ ID NO: 536230 - RNA, 32 nt, Human
uuccgaacgagucuccuuuccuuggggcucgc

SEQ ID NO: 536231 - RNA, 22 nt, Human
uuccgaaggaagagucuuuuca

SEQ ID NO: 536232 - RNA, 32 nt, Human
uuccgaaggcauuuuccacuaguuuuuggacu

SEQ ID NO: 536233 - RNA, 32 nt, Human
uuccgaagucuaccuagugccccagccgaacc

SEQ ID NO: 536234 - RNA, 22 nt, Human
uuccgaccacucagcugucagg

SEQ ID NO: 536235 - RNA, 32 nt, Human
uuccgacccugcccugugccccggcccaccug

SEQ ID NO: 536236 - RNA, 32 nt, Human
uuccgaccgcugcgcgcggcuccugggcuguc

SEQ ID NO: 536237 - RNA, 32 nt, Human
uuccgaccuccacccggaccccgaccccgacc

SEQ ID NO: 536238 - RNA, 23 nt, Human
uuccgacugccaucuuggacuug

SEQ ID NO: 536239 - RNA, 32 nt, Human
uuccgagagaaaaggggcagcuggaggcagau

SEQ ID NO: 536240 - RNA, 32 nt, Human
uuccgagcaaacaugugagcccaggaauuucc

SEQ ID NO: 536241 - RNA, 32 nt, Human
uuccgaggaagagaaugcugagccaggguuua

SEQ ID NO: 536242 - RNA, 32 nt, Human
uuccgaggaauagaggagaguguaagggagua

SEQ ID NO: 536243 - RNA, 24 nt, Human
uuccgaggagcuuucuggcugccu

SEQ ID NO: 536244 - RNA, 32 nt, Human
uuccgaggccaccguuuaacaggaguccccgc

SEQ ID NO: 536245 - RNA, 32 nt, Human
uuccgaggcugcagggccaggcgcgggaccgc

SEQ ID NO: 536246 - RNA, 32 nt, Human
uuccgaggcuucugcacucgccugggaagagg

SEQ ID NO: 536247 - RNA, 32 nt, Human
uuccgagggaggcaggggacggccagcggcag

SEQ ID NO: 536248 - RNA, 32 nt, Human
uuccgagugagugccaucgucaccuacgugag

SEQ ID NO: 536249 - RNA, 32 nt, Human
uuccgagugccuggcccagucucucccgccuc

SEQ ID NO: 536250 - RNA, 32 nt, Human
uuccgaguugcucuucuuccaggcuccguugg

SEQ ID NO: 536251 - RNA, 32 nt, Human
uuccgaugugccaccugcaguaguggaucaug

SEQ ID NO: 536252 - RNA, 21 nt, Human
uuccgauuaccuagauaccuc

SEQ ID NO: 536253 - RNA, 32 nt, Human
uuccgauuuacaaauguaaaauugcagcuuau

SEQ ID NO: 536254 - RNA, 32 nt, Human
uuccgcaaccuggaguuggaggcauugcaggc

SEQ ID NO: 536255 - RNA, 32 nt, Human
uuccgcaagugcugggauuacaggcgugagcu

SEQ ID NO: 536256 - RNA, 32 nt, Human
uuccgcaccaauaaagccuucaaacucccuaa

SEQ ID NO: 536257 - RNA, 32 nt, Human
uuccgcaccucuccaucuucaucuacgcagcc

SEQ ID NO: 536258 - RNA, 32 nt, Human
uuccgcacgcuuccaccuccuucgaccuccac

SEQ ID NO: 536259 - RNA, 32 nt, Human
uuccgcacuucacuugcagguucugagagagg

SEQ ID NO: 536260 - RNA, 32 nt, Human
uuccgcagacuggccaagagccagguucuaag

SEQ ID NO: 536261 - RNA, 32 nt, Human
uuccgcagagaaaacugaagccucccaucgug

SEQ ID NO: 536262 - RNA, 32 nt, Human
uuccgcagagaccagagaucucuguacuucaa

SEQ ID NO: 536263 - RNA, 32 nt, Human
uuccgcagucugaggcucagggccaggcuguu

SEQ ID NO: 536264 - RNA, 24 nt, Human
uuccgcaguguggccaggcugccu

SEQ ID NO: 536265 - RNA, 32 nt, Human
uuccgcauaacacuuccuaucuugucacugag

SEQ ID NO: 536266 - RNA, 32 nt, Human
uuccgcaugccuccugccuccugggcuauucc

SEQ ID NO: 536267 - RNA, 32 nt, Human
uuccgcaugcuguguuaaggggagacuaggcu

SEQ ID NO: 536268 - RNA, 32 nt, Human
uuccgccaucuugauucuuucucacugaccaa

SEQ ID NO: 536269 - RNA, 32 nt, Human
uuccgcccucuuugagaacucagaccugacca

SEQ ID NO: 536270 - RNA, 32 nt, Human
uuccgcccugggaaagcggcuucccagaccuc

SEQ ID NO: 536271 - RNA, 23 nt, Human
uuccgccgccugccccagugugg

SEQ ID NO: 536272 - RNA, 32 nt, Human
uuccgccggguuucacuguccgugacuuccuu

SEQ ID NO: 536273 - RNA, 32 nt, Human
uuccgccucccacccucuccccaucugcucug

SEQ ID NO: 536274 - RNA, 32 nt, Human
uuccgccucuacugguucccgcucaagguccu

SEQ ID NO: 536275 - RNA, 32 nt, Human
uuccgccuggcuuaccacaguugugugugguu

SEQ ID NO: 536276 - RNA, 32 nt, Human
uuccgccuguaaucccagcacuuugggagguc

SEQ ID NO: 536277 - RNA, 32 nt, Human
uuccgcgacccccaucagccccgccucacucu

SEQ ID NO: 536278 - RNA, 32 nt, Human
uuccgcgagccgggcugaguuggugaacacgg

SEQ ID NO: 536279 - RNA, 32 nt, Human
uuccgcgccaugcagagcccagucucuggcac

SEQ ID NO: 536280 - RNA, 32 nt, Human
uuccgcgcugccggcagggcuugggggcgccu

SEQ ID NO: 536281 - RNA, 32 nt, Human
uuccgcgggaggcgggcgggaggcggacgcgg

SEQ ID NO: 536282 - RNA, 32 nt, Human
uuccgcgggagggagaguuagcuagccaucca

SEQ ID NO: 536283 - RNA, 32 nt, Human
uuccgcucacugcaaccuccgccucccagguu

SEQ ID NO: 536284 - RNA, 32 nt, Human
uuccgcucacugcaaccucugcuucccggguu

SEQ ID NO: 536285 - RNA, 32 nt, Human
uuccgcuccaggaaggcgaggucggaucugag

SEQ ID NO: 536286 - RNA, 32 nt, Human
uuccgcuccuuugccagcaccgagcucuucca

SEQ ID NO: 536287 - RNA, 32 nt, Human
uuccgcugcauccagacuuccucaggcggugg

SEQ ID NO: 536288 - RNA, 32 nt, Human
uuccgcugccucauuccuuuccuuccuagccu

SEQ ID NO: 536289 - RNA, 32 nt, Human
uuccgcuggagcugucugccaaaagaaacugc

SEQ ID NO: 536290 - RNA, 32 nt, Human
uuccgcuuccacagggccgcccccucuccucc

SEQ ID NO: 536291 - RNA, 32 nt, Human
uuccgcuuugcacuccaccccgguagcagcuc

SEQ ID NO: 536292 - RNA, 32 nt, Human
uuccggaaaagugcuggagaggauguggagaa

SEQ ID NO: 536293 - RNA, 32 nt, Human
uuccggaaggggaggaagcgggaggcaggccu

SEQ ID NO: 536294 - RNA, 32 nt, Human
uuccggacacuguggagagggaccaguggugg

SEQ ID NO: 536295 - RNA, 25 nt, Human
uuccggagcagccccacauaccuca

SEQ ID NO: 536296 - RNA, 31 nt, Human
uuccggaggaaaccuguuugacuugaguaga

SEQ ID NO: 536297 - RNA, 32 nt, Human
uuccggaggagacgggggcagcuuggcuugag

SEQ ID NO: 536298 - RNA, 32 nt, Human
uuccggaggcugaggccaggaggaugggugga

SEQ ID NO: 536299 - RNA, 32 nt, Human
uuccggagucaggcaggaaggagaagcacagc

SEQ ID NO: 536300 - RNA, 32 nt, Human
uuccggcccacaccuauggcucaggccgaggc

SEQ ID NO: 536301 - RNA, 24 nt, Human
uuccggccugaggaagaagaggca

SEQ ID NO: 536302 - RNA, 32 nt, Human
uuccggcuccucccucuccuugugccucagcg

SEQ ID NO: 536303 - RNA, 32 nt, Human
uuccggcugugugcagcaugggugauaaggaa

SEQ ID NO: 536304 - RNA, 32 nt, Human
uuccgggaaggaacugaccagcgacugagcgg

SEQ ID NO: 536305 - RNA, 23 nt, Human
uuccgggaaugacagauaccuca

SEQ ID NO: 536306 - RNA, 15 nt, Human
uuccgggacagggag

SEQ ID NO: 536307 - RNA, 32 nt, Human
uuccgggagcccagagagcauguggcaggcag

SEQ ID NO: 536308 - RNA, 32 nt, Human
uuccgggcaacuuugaaaacaaacccuggucu

SEQ ID NO: 536309 - RNA, 24 nt, Human
uuccgggccuccucccgggccuca

SEQ ID NO: 536310 - RNA, 32 nt, Human
uuccgggccucgcuucccccagccccugcgcc

SEQ ID NO: 536311 - RNA, 32 nt, Human
uuccgggcucaagcgauucuccagccucagcc

SEQ ID NO: 536312 - RNA, 32 nt, Human
uuccgggcucggcuugaccuuuuccuaccuag

SEQ ID NO: 536313 - RNA, 32 nt, Human
uuccgggggccaggcggccgccgcgagucugg

SEQ ID NO: 536314 - RNA, 32 nt, Human
uuccgggggccuucccucgggucccuggcaga

SEQ ID NO: 536315 - RNA, 32 nt, Human
uuccgggggcugcaccugccugccuuugccua

SEQ ID NO: 536316 - RNA, 32 nt, Human
uuccggggucucugcucuuaugcaucaggacg

SEQ ID NO: 536317 - RNA, 32 nt, Human
uuccggguagcugggacuacaggugugcacca

SEQ ID NO: 536318 - RNA, 32 nt, Human
uuccggguccaaguccaugagcucucggcccu

SEQ ID NO: 536319 - RNA, 32 nt, Human
uuccgggugugcccugucccagaagauggaau

SEQ ID NO: 536320 - RNA, 32 nt, Human
uuccggguucaagugauucuccuaucucagcc

SEQ ID NO: 536321 - RNA, 32 nt, Human
uuccggguucaagugauucucgugccucagcc

SEQ ID NO: 536322 - RNA, 32 nt, Human
uuccggguucacaccauucuccugccucagcc

SEQ ID NO: 536323 - RNA, 32 nt, Human
uuccggguucaugccauucuccugccucagcc

SEQ ID NO: 536324 - RNA, 32 nt, Human
uuccggguuuguggcugcuuggcuccacacgu

SEQ ID NO: 536325 - RNA, 32 nt, Human
uuccgguauucugaggaugacguggccacuua

SEQ ID NO: 536326 - RNA, 32 nt, Human
uuccggugaagcggaggugugguggggcuugc

SEQ ID NO: 536327 - RNA, 32 nt, Human
uuccguaggcaauaacgugcguccgccucagc

SEQ ID NO: 536328 - RNA, 23 nt, Human
uuccgucagagcuucuggcugcu

SEQ ID NO: 536329 - RNA, 32 nt, Human
uuccguccugggaacugucagucugggagagc

SEQ ID NO: 536330 - RNA, 32 nt, Human
uuccgucgccacccucucuggacagcccaggg

SEQ ID NO: 536331 - RNA, 32 nt, Human
uuccgugaauguauauugucuuguaauguugc

SEQ ID NO: 536332 - RNA, 32 nt, Human
uuccgugauguaggguaaggugccuucuuauu

SEQ ID NO: 536333 - RNA, 32 nt, Human
uuccgugcucuucugcagucuuuguaugcuac

SEQ ID NO: 536334 - RNA, 32 nt, Human
uuccgugcuggcauauuuuggaauucuucaca

SEQ ID NO: 536335 - RNA, 32 nt, Human
uuccguggaggcgcagcccccaugcuccgugg

SEQ ID NO: 536336 - RNA, 32 nt, Human
uuccguggcccagggagguguuugcuguccga

SEQ ID NO: 536337 - RNA, 32 nt, Human
uuccguggggccaucuccucagcuucacagaa

SEQ ID NO: 536338 - RNA, 32 nt, Human
uuccguggguuuccccuuugauucuguaaaua

SEQ ID NO: 536339 - RNA, 32 nt, Human
uuccgugugccagcacuagccuaggagguuuu

SEQ ID NO: 536340 - RNA, 32 nt, Human
uuccguguggauggaucacaucccgagggugg

SEQ ID NO: 536341 - RNA, 32 nt, Human
uuccguguuuggcugaaccugggagaccagcu

SEQ ID NO: 536342 - RNA, 32 nt, Human
uuccguuccuggaucuacggagucuucuaaga

SEQ ID NO: 536343 - RNA, 32 nt, Human
uuccguugacucagugcugcugcuccagggug

SEQ ID NO: 536344 - RNA, 32 nt, Human
uuccguugucccuucgcgccccaaaccacauc

SEQ ID NO: 536345 - RNA, 32 nt, Human
uuccguuuccgacuugggguucaggcaggcug

SEQ ID NO: 536346 - RNA, 32 nt, Human
uuccguuucucauucuuggucuugagcugguc

SEQ ID NO: 536347 - RNA, 32 nt, Human
uuccguuugaggucagacacacaaaaccuucg

SEQ ID NO: 536348 - RNA, 32 nt, Human
uuccuaaaagauggaaacaggaaaguagguag

SEQ ID NO: 536349 - RNA, 32 nt, Human
uuccuaaagauuagagaucauuucucauucuc

SEQ ID NO: 536350 - RNA, 32 nt, Human
uuccuaaaggaaaugcccccggggaggacauu

SEQ ID NO: 536351 - RNA, 32 nt, Human
uuccuaaagugcugggauuacaggcgugagcc

SEQ ID NO: 536352 - RNA, 32 nt, Human
uuccuaaagugcugggauuacuggcaugagug

SEQ ID NO: 536353 - RNA, 32 nt, Human
uuccuaaagugcugggauugcaggcgugagcc

SEQ ID NO: 536354 - RNA, 32 nt, Human
uuccuaaaguguugggauuacaggcuugagcc

SEQ ID NO: 536355 - RNA, 32 nt, Human
uuccuaaauagcuggaauuacaggugugagcc

SEQ ID NO: 536356 - RNA, 32 nt, Human
uuccuaaauauuugcuacacacacagcuguau

SEQ ID NO: 536357 - RNA, 32 nt, Human
uuccuaaaugacugcauaggacagaucccauc

SEQ ID NO: 536358 - RNA, 32 nt, Human
uuccuaaaugauuuugaagggaaaguacuauu

SEQ ID NO: 536359 - RNA, 32 nt, Human
uuccuaaaugggaugcaaaaagaaacugaaug

SEQ ID NO: 536360 - RNA, 24 nt, Human
uuccuaaauuguuacaaugcuuua

SEQ ID NO: 536361 - RNA, 32 nt, Human
uuccuaacaaaccuuaccucagcugaaaugga

SEQ ID NO: 536362 - RNA, 32 nt, Human
uuccuaacacccacugaauggaaagcaggaag

SEQ ID NO: 536363 - RNA, 32 nt, Human
uuccuaaccagccuggucaacauggugaaacc

SEQ ID NO: 536364 - RNA, 32 nt, Human
uuccuaacucggccucacgucacagagcguca

SEQ ID NO: 536365 - RNA, 32 nt, Human
uuccuaacugcuacaaauacucuuaggaagag

SEQ ID NO: 536366 - RNA, 32 nt, Human
uuccuaagaagaggaaaauagcagaagagaag

SEQ ID NO: 536367 - RNA, 32 nt, Human
uuccuaagagccucuuuccuucauaccaucuu

SEQ ID NO: 536368 - RNA, 32 nt, Human
uuccuaagauuuccuuggguaucugguuuuug

SEQ ID NO: 536369 - RNA, 32 nt, Human
uuccuaaggaacagacuuaaguaugcccugac

SEQ ID NO: 536370 - RNA, 32 nt, Human
uuccuaaggaacagacuuaaguaugcccugga

SEQ ID NO: 536371 - RNA, 32 nt, Human
uuccuaaggacuccugaugucaucucaccagg

SEQ ID NO: 536372 - RNA, 32 nt, Human
uuccuaaggagauuuauauucuggccuacaca

SEQ ID NO: 536373 - RNA, 20 nt, Human
uuccuaaggcccagcugcca

SEQ ID NO: 536374 - RNA, 32 nt, Human
uuccuaaggccuucccaggagccaagcagaug

SEQ ID NO: 536375 - RNA, 32 nt, Human
uuccuaagggaugcaggaaggggccgggugaa

SEQ ID NO: 536376 - RNA, 32 nt, Human
uuccuaaguagcugggauuacaggcgugcgcc

SEQ ID NO: 536377 - RNA, 32 nt, Human
uuccuaaguagcuggguuuacaggcacccacc

SEQ ID NO: 536378 - RNA, 31 nt, Human
uuccuaagugagagagagccuggcugaagcu

SEQ ID NO: 536379 - RNA, 23 nt, Human
uuccuaaguggagauggccugua

SEQ ID NO: 536380 - RNA, 32 nt, Human
uuccuaaguugcuguccagccucagugacccc

SEQ ID NO: 536381 - RNA, 32 nt, Human
uuccuaaguuuuuguuaguugugucuucgaau

SEQ ID NO: 536382 - RNA, 32 nt, Human
uuccuacagaaaugacaacaugcgugugcaaa

SEQ ID NO: 536383 - RNA, 32 nt, Human
uuccuacagaugugccagcuugauuccuacca

SEQ ID NO: 536384 - RNA, 32 nt, Human
uuccuacagcagcaguccuuggaguugcuggc

SEQ ID NO: 536385 - RNA, 32 nt, Human
uuccuacaggcagagucaggccacacuggccc

SEQ ID NO: 536386 - RNA, 32 nt, Human
uuccuacaggcagagucaggccgcacuggccc

SEQ ID NO: 536387 - RNA, 32 nt, Human
uuccuacaggcagagucaggccgcacuggccu

SEQ ID NO: 536388 - RNA, 32 nt, Human
uuccuacaggggguggagagaccagccuuucu

SEQ ID NO: 536389 - RNA, 32 nt, Human
uuccuacauagaacauguauauucuacaaucu

SEQ ID NO: 536390 - RNA, 32 nt, Human
uuccuacaucuucucuucaccuaucccuugua

SEQ ID NO: 536391 - RNA, 32 nt, Human
uuccuaccagugucugcuauuuugaagaagcu

SEQ ID NO: 536392 - RNA, 32 nt, Human
uuccuacccaggcugccuggccggggccacug

SEQ ID NO: 536393 - RNA, 32 nt, Human
uuccuacccaggcugccuggcuggggccacug

SEQ ID NO: 536394 - RNA, 32 nt, Human
uuccuaccccuguucccuccccaaacccuauc

SEQ ID NO: 536395 - RNA, 24 nt, Human
uuccuacccuaccucggggaccug

SEQ ID NO: 536396 - RNA, 32 nt, Human
uuccuaccuaucccaccuccaucccagacagg

SEQ ID NO: 536397 - RNA, 32 nt, Human
uuccuaccugacuaugcuuucucuccuaggag

SEQ ID NO: 536398 - RNA, 32 nt, Human
uuccuaccugcagauccaggggcugcuguugc

SEQ ID NO: 536399 - RNA, 32 nt, Human
uuccuacguccaacugccguucacaacugccc

SEQ ID NO: 536400 - RNA, 32 nt, Human
uuccuacguuuuucuauguaauauuauuccau

SEQ ID NO: 536401 - RNA, 32 nt, Human
uuccuacuccacccuguaacauucagucuccu

SEQ ID NO: 536402 - RNA, 32 nt, Human
uuccuacucuacaauccuuuccucgaccaacg

SEQ ID NO: 536403 - RNA, 32 nt, Human
uuccuacucugaguuacugguuaccuagccag

SEQ ID NO: 536404 - RNA, 32 nt, Human
uuccuacugccuccacuucauguuauuuucuu

SEQ ID NO: 536405 - RNA, 32 nt, Human
uuccuacugucaucuuggagaaacccagucac

SEQ ID NO: 536406 - RNA, 32 nt, Human
uuccuacuuguccagguggagugagucugagg

SEQ ID NO: 536407 - RNA, 32 nt, Human
uuccuacuuugagggucucaucaugcccacug

SEQ ID NO: 536408 - RNA, 32 nt, Human
uuccuagaagcagccuuugcugucuuuuuaca

SEQ ID NO: 536409 - RNA, 32 nt, Human
uuccuagagacaggauuucgccauguugccug

SEQ ID NO: 536410 - RNA, 32 nt, Human
uuccuagagaugcagaacugggcccguggagc

SEQ ID NO: 536411 - RNA, 32 nt, Human
uuccuagagccuuauuagaaaugcagaaucug

SEQ ID NO: 536412 - RNA, 32 nt, Human
uuccuagaggcagagguugaagauggaagagg

SEQ ID NO: 536413 - RNA, 32 nt, Human
uuccuagcauaucccagagaacucauuugcca

SEQ ID NO: 536414 - RNA, 24 nt, Human
uuccuagccauugcugauguuuua

SEQ ID NO: 536415 - RNA, 32 nt, Human
uuccuagcccuucccccuccccaagacugugg

SEQ ID NO: 536416 - RNA, 32 nt, Human
uuccuagcuauccucugaaaacaguaugaaac

SEQ ID NO: 536417 - RNA, 32 nt, Human
uuccuaggagagugucuguuugcaugauaugu

SEQ ID NO: 536418 - RNA, 32 nt, Human
uuccuaggaggaaguagcaccacuggagcaga

SEQ ID NO: 536419 - RNA, 32 nt, Human
uuccuaggaguuguucuguccaccuguagacc

SEQ ID NO: 536420 - RNA, 32 nt, Human
uuccuagggaaagcuaagggagagggaauaug

SEQ ID NO: 536421 - RNA, 32 nt, Human
uuccuagggagaagcaggauacuuucccucag

SEQ ID NO: 536422 - RNA, 32 nt, Human
uuccuaggggacccugagcuuggcucccagga

SEQ ID NO: 536423 - RNA, 32 nt, Human
uuccuagguugcaguucagggaagggaaacaa

SEQ ID NO: 536424 - RNA, 32 nt, Human
uuccuaguaggaacuucuuccucuucagcccg

SEQ ID NO: 536425 - RNA, 32 nt, Human
uuccuagucuggagaggauauggaaauuuguu

SEQ ID NO: 536426 - RNA, 32 nt, Human
uuccuagugugggccaggaacaggacagggag

SEQ ID NO: 536427 - RNA, 32 nt, Human
uuccuaguucccauucuccuuuauuuucuucc

SEQ ID NO: 536428 - RNA, 32 nt, Human
uuccuauauuucuucuggaaucauguucgcuu

SEQ ID NO: 536429 - RNA, 32 nt, Human
uuccuaucacucaaggccccagccuggcacaa

SEQ ID NO: 536430 - RNA, 32 nt, Human
uuccuaucaggacuguguaugucugagcacau

SEQ ID NO: 536431 - RNA, 32 nt, Human
uuccuaucaugcuucaugugucauuccaaggu

SEQ ID NO: 536432 - RNA, 32 nt, Human
uuccuaucauucagaucuuccuuccucccaag

SEQ ID NO: 536433 - RNA, 32 nt, Human
uuccuaucauucuccaaaggccuccgcaauua

SEQ ID NO: 536434 - RNA, 32 nt, Human
uuccuaucccugggugcaugugcauucagaaa

SEQ ID NO: 536435 - RNA, 32 nt, Human
uuccuaucucuagcaaccuccugggccccaug

SEQ ID NO: 536436 - RNA, 32 nt, Human
uuccuaucuggcauuuccaucuugccccuggu

SEQ ID NO: 536437 - RNA, 32 nt, Human
uuccuaugcauacucuagaaucauauugucua

SEQ ID NO: 536438 - RNA, 32 nt, Human
uuccuaugguaauuaggagcaaaugaguuauu

SEQ ID NO: 536439 - RNA, 32 nt, Human
uuccuauguagaaggcucaguguuagaaauaa

SEQ ID NO: 536440 - RNA, 32 nt, Human
uuccuauucucagaccaugccaguggcaaccu

SEQ ID NO: 536441 - RNA, 32 nt, Human
uuccuauucucagaccaugccaguggccaccu

SEQ ID NO: 536442 - RNA, 32 nt, Human
uuccuauugcaaccucgugcacugcucgagac

SEQ ID NO: 536443 - RNA, 32 nt, Human
uuccuauugcccuuucuuuucacccaccauuc

SEQ ID NO: 536444 - RNA, 32 nt, Human
uuccuauuucaaccucugguuccugggaugag

SEQ ID NO: 536445 - RNA, 32 nt, Human
uuccuauuucaggaaagggaaauggugucacu

SEQ ID NO: 536446 - RNA, 19 nt, Human
uuccuauuucuggcugccu

SEQ ID NO: 536447 - RNA, 32 nt, Human
uuccuauuugaauuucuuuggugcuguagaaa

SEQ ID NO: 536448 - RNA, 26 nt, Human
uuccucaaauaacaaagaaaaaugau

SEQ ID NO: 536449 - RNA, 32 nt, Human
uuccucaaccauaaaaugaagauaauaaugcc

SEQ ID NO: 536450 - RNA, 32 nt, Human
uuccucaacugccccaaaucucuuaauagcuu

SEQ ID NO: 536451 - RNA, 32 nt, Human
uuccucaagacaaaugguaauuugcuaggcac

SEQ ID NO: 536452 - RNA, 32 nt, Human
uuccucaaggaggugaaggucaugcgaugccu

SEQ ID NO: 536453 - RNA, 31 nt, Human
uuccucaaguaauauaccuguuugaagcuuu

SEQ ID NO: 536454 - RNA, 32 nt, Human
uuccucaagucaagcguuccaggcccagauca

SEQ ID NO: 536455 - RNA, 32 nt, Human
uuccucaaguuaguuauguuguaggaguguac

SEQ ID NO: 536456 - RNA, 32 nt, Human
uuccucaauccuuacuaaacauucauguaauu

SEQ ID NO: 536457 - RNA, 23 nt, Human
uuccucacacaccgcagcaaaga

SEQ ID NO: 536458 - RNA, 32 nt, Human
uuccucacauagagucauuguauuccaccugu

SEQ ID NO: 536459 - RNA, 32 nt, Human
uuccucaccaauaacuucagagaagucaguug

SEQ ID NO: 536460 - RNA, 32 nt, Human
uuccucacccaaauuacuauguuuccacaaga

SEQ ID NO: 536461 - RNA, 32 nt, Human
uuccucacccccagugccuggacccggaggug

SEQ ID NO: 536462 - RNA, 18 nt, Human
uuccucaccccucuccca

SEQ ID NO: 536463 - RNA, 32 nt, Human
uuccucaccgauggagaauuacuuccaagcag

SEQ ID NO: 536464 - RNA, 32 nt, Human
uuccucaccuggcuugggccacugugcacagc

SEQ ID NO: 536465 - RNA, 32 nt, Human
uuccucacucacugcaacuggaucuucagccu

SEQ ID NO: 536466 - RNA, 32 nt, Human
uuccucacuccauccagccucuugacaagcac

SEQ ID NO: 536467 - RNA, 32 nt, Human
uuccucacuccuccugccuccacccccuacca

SEQ ID NO: 536468 - RNA, 32 nt, Human
uuccucacugcaccuagucagacugugggcau

SEQ ID NO: 536469 - RNA, 32 nt, Human
uuccucagcccuggaugaaguggagaagaccu

SEQ ID NO: 536470 - RNA, 32 nt, Human
uuccucagccuccugaguagcugggauuacag

SEQ ID NO: 536471 - RNA, 32 nt, Human
uuccucagccuccugaguagcugggauuaugg

SEQ ID NO: 536472 - RNA, 32 nt, Human
uuccucagcucccuucugccccucucuaccuc

SEQ ID NO: 536473 - RNA, 30 nt, Human
uuccucagcuucuccauguuuaggaacuga

SEQ ID NO: 536474 - RNA, 32 nt, Human
uuccucaggagagguugagucuaccuaggacc

SEQ ID NO: 536475 - RNA, 32 nt, Human
uuccucaggagcccucacucugccuguggacg

SEQ ID NO: 536476 - RNA, 32 nt, Human
uuccucaggcuaagcugccgguucuuaaaucc

SEQ ID NO: 536477 - RNA, 32 nt, Human
uuccucaggcuguuaccugcccccucaggccc

SEQ ID NO: 536478 - RNA, 32 nt, Human
uuccucagggccuucucccagagacagccugg

SEQ ID NO: 536479 - RNA, 32 nt, Human
uuccucagggcuuagggagggagggaggacau

SEQ ID NO: 536480 - RNA, 32 nt, Human
uuccucagugcaggggugcaucagggccucaa

SEQ ID NO: 536481 - RNA, 32 nt, Human
uuccucagugccuguccauaacugugaaguau

SEQ ID NO: 536482 - RNA, 31 nt, Human
uuccucaguuucucuggguuuuggugucuca

SEQ ID NO: 536483 - RNA, 32 nt, Human
uuccucaguuuuucuuccucagaauaaauggg

SEQ ID NO: 536484 - RNA, 32 nt, Human
uuccucauaauggccagcauuuugggcuacaa

SEQ ID NO: 536485 - RNA, 32 nt, Human
uuccucaucagagguggacaagcccuaugggc

SEQ ID NO: 536486 - RNA, 32 nt, Human
uuccucauccaccgcugcugagucucagaaac

SEQ ID NO: 536487 - RNA, 16 nt, Human
uuccucauccccccuc

SEQ ID NO: 536488 - RNA, 32 nt, Human
uuccucaucugcagcuacgccuggguguggug

SEQ ID NO: 536489 - RNA, 32 nt, Human
uuccucaucugucaggagugccauuaaaggag

SEQ ID NO: 536490 - RNA, 32 nt, Human
uuccucaucuuccuccucuuccuucuuuuucu

SEQ ID NO: 536491 - RNA, 32 nt, Human
uuccucaucuuccucuugcugcugccauguaa

SEQ ID NO: 536492 - RNA, 24 nt, Human
uuccucauuccauugccccagguc

SEQ ID NO: 536493 - RNA, 32 nt, Human
uuccucauugacugacucugugccacgucauc

SEQ ID NO: 536494 - RNA, 32 nt, Human
uuccucauuuuacuuuuaaacuggugguaaag

SEQ ID NO: 536495 - RNA, 32 nt, Human
uuccucauuuuguuugacaggguccucaguac

SEQ ID NO: 536496 - RNA, 32 nt, Human
uuccuccaaaugcuaugagagcaggggaguaa

SEQ ID NO: 536497 - RNA, 32 nt, Human
uuccuccaaugccuggugauucuugaaugucu

SEQ ID NO: 536498 - RNA, 32 nt, Human
uuccuccaaugugcuuucacagcuucacuucc

SEQ ID NO: 536499 - RNA, 32 nt, Human
uuccuccacaaaaugauccucagucuguaauu

SEQ ID NO: 536500 - RNA, 32 nt, Human
uuccuccacaaacagcucuucauaacaugggc

SEQ ID NO: 536501 - RNA, 32 nt, Human
uuccuccaccaagcuccugugugagcugcagc

SEQ ID NO: 536502 - RNA, 24 nt, Human
uuccuccacccaggguugacucag

SEQ ID NO: 536503 - RNA, 32 nt, Human
uuccuccacccuaagcccuggggcccugaaau

SEQ ID NO: 536504 - RNA, 19 nt, Human
uuccuccaccugcuggguc

SEQ ID NO: 536505 - RNA, 32 nt, Human
uuccuccacugcauugccauccuccccaaagc

SEQ ID NO: 536506 - RNA, 32 nt, Human
uuccuccagaacugagcccuuuguuggaacca

SEQ ID NO: 536507 - RNA, 32 nt, Human
uuccuccagaccgcaggcucccccagccucag

SEQ ID NO: 536508 - RNA, 23 nt, Human
uuccuccagagacacugagccag

SEQ ID NO: 536509 - RNA, 32 nt, Human
uuccuccagagcagagaaacgccugaccugcc

SEQ ID NO: 536510 - RNA, 32 nt, Human
uuccuccagcaacccauaccuaauaagaagga

SEQ ID NO: 536511 - RNA, 32 nt, Human
uuccuccagcuauccucagggaagcuggagau

SEQ ID NO: 536512 - RNA, 32 nt, Human
uuccuccagcucuuccugagaccaggguuucc

SEQ ID NO: 536513 - RNA, 32 nt, Human
uuccuccagcuuuccugagagaaacaggucaa

SEQ ID NO: 536514 - RNA, 32 nt, Human
uuccuccaggaucauggugaagaugacaugag

SEQ ID NO: 536515 - RNA, 32 nt, Human
uuccuccagggugggaagcacggggagcaaug

SEQ ID NO: 536516 - RNA, 32 nt, Human
uuccuccaggucuuugauuggagagaguaacu

SEQ ID NO: 536517 - RNA, 32 nt, Human
uuccuccaucagccuggcuggcagcagccuug

SEQ ID NO: 536518 - RNA, 32 nt, Human
uuccuccauccugucuggaauacaccagguca

SEQ ID NO: 536519 - RNA, 32 nt, Human
uuccuccaugcaucuugcccaggaucacucag

SEQ ID NO: 536520 - RNA, 32 nt, Human
uuccuccaugggcgcucagccuggggaaccuc

SEQ ID NO: 536521 - RNA, 32 nt, Human
uuccuccauguauuuacuccauuuuucucuau

SEQ ID NO: 536522 - RNA, 32 nt, Human
uuccucccaaagugcugggauuaauggcguga

SEQ ID NO: 536523 - RNA, 32 nt, Human
uuccucccaagaaacagcagcucaaacagugg

SEQ ID NO: 536524 - RNA, 32 nt, Human
uuccucccaaguagcugcaacuaugggcauac

SEQ ID NO: 536525 - RNA, 32 nt, Human
uuccucccacuauuuucucuucgcaggacaug

SEQ ID NO: 536526 - RNA, 32 nt, Human
uuccucccagacccauaacccuugucuuagua

SEQ ID NO: 536527 - RNA, 32 nt, Human
uuccucccagcccuguaaauucuaucuuugau

SEQ ID NO: 536528 - RNA, 32 nt, Human
uuccucccagcugggucuacagucccaucucc

SEQ ID NO: 536529 - RNA, 32 nt, Human
uuccucccaguuccagagcaccccaggauaac

SEQ ID NO: 536530 - RNA, 32 nt, Human
uuccucccaugcacuccuagggugaaugggcu

SEQ ID NO: 536531 - RNA, 32 nt, Human
uuccucccaugcacuccuaggugaaugggcuc

SEQ ID NO: 536532 - RNA, 32 nt, Human
uuccuccccaacaaaagaggcuuuucuucuua

SEQ ID NO: 536533 - RNA, 32 nt, Human
uuccuccccacucugucuuucucaccucuccu

SEQ ID NO: 536534 - RNA, 32 nt, Human
uuccuccccacuucaccaacacugccuuccuc

SEQ ID NO: 536535 - RNA, 32 nt, Human
uuccuccccagcagccgggucucuccagaccc

SEQ ID NO: 536536 - RNA, 19 nt, Human
uuccuccccaggagugaaa

SEQ ID NO: 536537 - RNA, 24 nt, Human
uuccuccccauccuggagaaugac

SEQ ID NO: 536538 - RNA, 32 nt, Human
uuccuccccgccuuccgccccuucccuucccu

SEQ ID NO: 536539 - RNA, 32 nt, Human
uuccuccccuagcaccugggcuuggcagaagg

SEQ ID NO: 536540 - RNA, 32 nt, Human
uuccuccccuccuccuccucuccaauucgccu

SEQ ID NO: 536541 - RNA, 32 nt, Human
uuccuccccugcccugcuucccuuccuccacc

SEQ ID NO: 536542 - RNA, 32 nt, Human
uuccuccccugccuccuuagaacacacucuaa

SEQ ID NO: 536543 - RNA, 32 nt, Human
uuccuccccuuucuacugcucucccauuuucc

SEQ ID NO: 536544 - RNA, 32 nt, Human
uuccucccgcagccccugcuacugagaagcuc

SEQ ID NO: 536545 - RNA, 32 nt, Human
uuccucccuccccucucccucccccucccccg

SEQ ID NO: 536546 - RNA, 32 nt, Human
uuccucccuccccuuaguugucuaugacuuuu

SEQ ID NO: 536547 - RNA, 32 nt, Human
uuccucccucuccucugcuuccagcaugcucu

SEQ ID NO: 536548 - RNA, 32 nt, Human
uuccucccucucucccugauguaggccuuggc

SEQ ID NO: 536549 - RNA, 31 nt, Human
uuccucccucucucugggcuuuguccugaga

SEQ ID NO: 536550 - RNA, 32 nt, Human
uuccucccugcaggagcuucccaagcugguca

SEQ ID NO: 536551 - RNA, 22 nt, Human
uuccucccuguccccacgacca

SEQ ID NO: 536552 - RNA, 32 nt, Human
uuccucccuuccuccucuccccacuccuuucc

SEQ ID NO: 536553 - RNA, 32 nt, Human
uuccucccuuucucccucucucccucuuccuc

SEQ ID NO: 536554 - RNA, 32 nt, Human
uuccucccuuucuccuucuccccuccuucuuu

SEQ ID NO: 536555 - RNA, 32 nt, Human
uuccucccuuucucucuguuucuguuccucuc

SEQ ID NO: 536556 - RNA, 32 nt, Human
uuccucccuuugcccaguagccacaucugguu

SEQ ID NO: 536557 - RNA, 32 nt, Human
uuccuccgcacugcaaacacauauaugugcgc

SEQ ID NO: 536558 - RNA, 32 nt, Human
uuccuccgucaccucagagacauacaccuaug

SEQ ID NO: 536559 - RNA, 32 nt, Human
uuccuccguucccaguccacuucucuagggcc

SEQ ID NO: 536560 - RNA, 32 nt, Human
uuccuccuaccugaccaggccauguccucucu

SEQ ID NO: 536561 - RNA, 32 nt, Human
uuccuccuagguaaaguccauggccauaucuu

SEQ ID NO: 536562 - RNA, 32 nt, Human
uuccuccucacugcauccccaauccccuuccc

SEQ ID NO: 536563 - RNA, 32 nt, Human
uuccuccucauugaagccaugccaucaccuug

SEQ ID NO: 536564 - RNA, 32 nt, Human
uuccuccuccagccucccuuggguuuucuuuu

SEQ ID NO: 536565 - RNA, 32 nt, Human
uuccuccuccaucaccugaaacacuggaccug

SEQ ID NO: 536566 - RNA, 32 nt, Human
uuccuccuccccaaggagcauaaugugauggu

SEQ ID NO: 536567 - RNA, 32 nt, Human
uuccuccuccuccuccuccucugguagagcac

SEQ ID NO: 536568 - RNA, 32 nt, Human
uuccuccuccuccuccucucccuccuccuccu

SEQ ID NO: 536569 - RNA, 32 nt, Human
uuccuccuccuccuccucucuaggcacccccg

SEQ ID NO: 536570 - RNA, 32 nt, Human
uuccuccuccucggccucaccauuccagacca

SEQ ID NO: 536571 - RNA, 32 nt, Human
uuccuccuccuugggccaugcaacgggaugaa

SEQ ID NO: 536572 - RNA, 32 nt, Human
uuccuccucuacugcucccucccucucuugcc

SEQ ID NO: 536573 - RNA, 32 nt, Human
uuccuccucuccucccuguccugagccuuagc

SEQ ID NO: 536574 - RNA, 32 nt, Human
uuccuccucugccuccccuuccccuccucucc

SEQ ID NO: 536575 - RNA, 32 nt, Human
uuccuccucuuccuccuccuccucuuccucau

SEQ ID NO: 536576 - RNA, 32 nt, Human
uuccuccucuucucagagaccucccuuuccaa

SEQ ID NO: 536577 - RNA, 32 nt, Human
uuccuccugacggcacucccaccuucaucauu

SEQ ID NO: 536578 - RNA, 32 nt, Human
uuccuccugagccagcccagacucggccugga

SEQ ID NO: 536579 - RNA, 32 nt, Human
uuccuccugaguagcugauuuucagaauuugg

SEQ ID NO: 536580 - RNA, 32 nt, Human
uuccuccugcagcugcugggccuuugccucug

SEQ ID NO: 536581 - RNA, 32 nt, Human
uuccuccugcaucuccccuucuuuccuucccc

SEQ ID NO: 536582 - RNA, 32 nt, Human
uuccuccugccaccccuccuguuccugcagcc

SEQ ID NO: 536583 - RNA, 32 nt, Human
uuccuccugccuggaccaugguagcuucugug

SEQ ID NO: 536584 - RNA, 32 nt, Human
uuccuccugcuccccuugacuuuuuccccuga

SEQ ID NO: 536585 - RNA, 32 nt, Human
uuccuccugggaaauuccaguaagggcgcgga

SEQ ID NO: 536586 - RNA, 32 nt, Human
uuccuccugggaagaugcagaggcucaugaug

SEQ ID NO: 536587 - RNA, 32 nt, Human
uuccuccugggaucuggcccuccagggaagug

SEQ ID NO: 536588 - RNA, 32 nt, Human
uuccuccugggcaacagagugagacccuauca

SEQ ID NO: 536589 - RNA, 32 nt, Human
uuccuccuggugcccugaaggcugcgauggcc

SEQ ID NO: 536590 - RNA, 31 nt, Human
uuccuccuuagugccaucacagcaggugaau

SEQ ID NO: 536591 - RNA, 32 nt, Human
uuccuccuucacccccaauccccaugccaguu

SEQ ID NO: 536592 - RNA, 32 nt, Human
uuccuccuucacuguuucaucuaagugccuca

SEQ ID NO: 536593 - RNA, 32 nt, Human
uuccuccuuccaggaacugguuucuugcgcgg

SEQ ID NO: 536594 - RNA, 32 nt, Human
uuccuccuugccacccuuccagccuuccaggc

SEQ ID NO: 536595 - RNA, 32 nt, Human
uuccuccuugccuucccuucugugugaccgac

SEQ ID NO: 536596 - RNA, 32 nt, Human
uuccuccuuuccaauuuggaugccuuagauuu

SEQ ID NO: 536597 - RNA, 32 nt, Human
uuccuccuuucucuuucguuacagaagcccca

SEQ ID NO: 536598 - RNA, 32 nt, Human
uuccuccuuugggcaucucuucugccucccaa

SEQ ID NO: 536599 - RNA, 32 nt, Human
uuccuccuuuucagaacuacucugugcuaauu

SEQ ID NO: 536600 - RNA, 32 nt, Human
uuccucgaccaacgcaaccucuaguaccuuuc

SEQ ID NO: 536601 - RNA, 32 nt, Human
uuccucgcacccagaugguagccagucuucca

SEQ ID NO: 536602 - RNA, 32 nt, Human
uuccucgcacuucuccccacucgucaucuuuu

SEQ ID NO: 536603 - RNA, 32 nt, Human
uuccucgcgcccccuucagccacuccgacugc

SEQ ID NO: 536604 - RNA, 32 nt, Human
uuccucgcuccucugcuggguuaagccugcaa

SEQ ID NO: 536605 - RNA, 32 nt, Human
uuccucggaaacacucuugaaugucugaguga

SEQ ID NO: 536606 - RNA, 32 nt, Human
uuccucggagggcagacacagggaggaaggac

SEQ ID NO: 536607 - RNA, 32 nt, Human
uuccucggagguguuuauugaugcccagcugc

SEQ ID NO: 536608 - RNA, 32 nt, Human
uuccucggagugagagaaaacucuuuuuagau

SEQ ID NO: 536609 - RNA, 32 nt, Human
uuccucggauccacaauuaaagaauuaacagc

SEQ ID NO: 536610 - RNA, 32 nt, Human
uuccucggcccagggagaaagcaugucaggac

SEQ ID NO: 536611 - RNA, 32 nt, Human
uuccucgggcagcaggugggaagugggagccg

SEQ ID NO: 536612 - RNA, 32 nt, Human
uuccucgggguccgcggagcgagcccagcucu

SEQ ID NO: 536613 - RNA, 32 nt, Human
uuccucguaagauuucucccuauuucauacuc

SEQ ID NO: 536614 - RNA, 32 nt, Human
uuccucgucaguggucaaggugugucauccau

SEQ ID NO: 536615 - RNA, 32 nt, Human
uuccucguguccggaggcaugggugagcaugg

SEQ ID NO: 536616 - RNA, 32 nt, Human
uuccucguucugcucugaccucuuagcuuaga

SEQ ID NO: 536617 - RNA, 32 nt, Human
uuccucuaaagcagucuugggaagcuggauca

SEQ ID NO: 536618 - RNA, 22 nt, Human
uuccucuaacaccuuccaugua

SEQ ID NO: 536619 - RNA, 32 nt, Human
uuccucuaccugcccucuccccagcccucauc

SEQ ID NO: 536620 - RNA, 32 nt, Human
uuccucuagccucugcuggagugcagugagga

SEQ ID NO: 536621 - RNA, 32 nt, Human
uuccucuaggcagagaagaggcgauggcggcg

SEQ ID NO: 536622 - RNA, 32 nt, Human
uuccucuagggaggggauggggaggccuccua

SEQ ID NO: 536623 - RNA, 32 nt, Human
uuccucuauuccuuuauaugaucucuguauuu

SEQ ID NO: 536624 - RNA, 32 nt, Human
uuccucuauuugccugccaccucucuugucuc

SEQ ID NO: 536625 - RNA, 23 nt, Human
uuccucucacaaaggaaaaugac

SEQ ID NO: 536626 - RNA, 20 nt, Human
uuccucucacuccaagugac

SEQ ID NO: 536627 - RNA, 32 nt, Human
uuccucucagaagggagagagguuuucaggcu

SEQ ID NO: 536628 - RNA, 32 nt, Human
uuccucucagcuauaagccucuugccuucaag

SEQ ID NO: 536629 - RNA, 32 nt, Human
uuccucucauuauugagaacugugaguguuua

SEQ ID NO: 536630 - RNA, 32 nt, Human
uuccucuccaagcccuccucugaaccagcuau

SEQ ID NO: 536631 - RNA, 32 nt, Human
uuccucuccacgccagugucucuaauaaacuu

SEQ ID NO: 536632 - RNA, 32 nt, Human
uuccucuccagccagaggcugaccugagggcc

SEQ ID NO: 536633 - RNA, 32 nt, Human
uuccucuccagccagucuccuguggcucccug

SEQ ID NO: 536634 - RNA, 32 nt, Human
uuccucuccagccuucucucucuggucaggcc

SEQ ID NO: 536635 - RNA, 32 nt, Human
uuccucucccccagccucccaggcuggauggc

SEQ ID NO: 536636 - RNA, 32 nt, Human
uuccucucccucauaauucagcauuaaagaau

SEQ ID NO: 536637 - RNA, 32 nt, Human
uuccucuccuacugcuaauuuuuccguccucu

SEQ ID NO: 536638 - RNA, 32 nt, Human
uuccucuccuccuccuccuccuggguccccca

SEQ ID NO: 536639 - RNA, 32 nt, Human
uuccucuccucucuuccucucuucucucuucc

SEQ ID NO: 536640 - RNA, 32 nt, Human
uuccucuccucuucacuagccucucugaaggu

SEQ ID NO: 536641 - RNA, 20 nt, Human
uuccucuccuggacaaugac

SEQ ID NO: 536642 - RNA, 21 nt, Human
uuccucuccuucgaagaugac

SEQ ID NO: 536643 - RNA, 32 nt, Human
uuccucucggcuaucacucaccccuguccuca

SEQ ID NO: 536644 - RNA, 32 nt, Human
uuccucucucaccaccccaucucccucucuuc

SEQ ID NO: 536645 - RNA, 32 nt, Human
uuccucucucccaccagggggcgcgcuuaaau

SEQ ID NO: 536646 - RNA, 32 nt, Human
uuccucucuccccuccccaccucgcuucuucc

SEQ ID NO: 536647 - RNA, 32 nt, Human
uuccucucucccucuuucuccucucucaccca

SEQ ID NO: 536648 - RNA, 32 nt, Human
uuccucucuccuccuccuuccccauugcugua

SEQ ID NO: 536649 - RNA, 32 nt, Human
uuccucucuccucuccuccuuccugucuccuc

SEQ ID NO: 536650 - RNA, 32 nt, Human
uuccucucuccucuuugaugucaaacgccuug

SEQ ID NO: 536651 - RNA, 32 nt, Human
uuccucucuccugguuccuccccaucugccug

SEQ ID NO: 536652 - RNA, 32 nt, Human
uuccucucugagucccagcuauggggaacauc

SEQ ID NO: 536653 - RNA, 32 nt, Human
uuccucucugcugaggcagcugccuccugauc

SEQ ID NO: 536654 - RNA, 32 nt, Human
uuccucucuguccugucucugccaccuccaca

SEQ ID NO: 536655 - RNA, 32 nt, Human
uuccucucugucugucucucccccucugucuu

SEQ ID NO: 536656 - RNA, 21 nt, Human
uuccucucuuaaaaaauguac

SEQ ID NO: 536657 - RNA, 19 nt, Human
uuccucucuuccuccaggg

SEQ ID NO: 536658 - RNA, 32 nt, Human
uuccucucuuucucuuccccuuuccuucgcgc

SEQ ID NO: 536659 - RNA, 32 nt, Human
uuccucucuuuggucacauggcgucagaugaa

SEQ ID NO: 536660 - RNA, 32 nt, Human
uuccucugaaaaggaaugaacacgggaacccc

SEQ ID NO: 536661 - RNA, 32 nt, Human
uuccucugaagacugcuaucagucucuuggac

SEQ ID NO: 536662 - RNA, 32 nt, Human
uuccucugagguuugaggaugaagauaaguug

SEQ ID NO: 536663 - RNA, 32 nt, Human
uuccucugcacugggccguggaugacauuaca

SEQ ID NO: 536664 - RNA, 32 nt, Human
uuccucugccacucccugcugugugacuuugg

SEQ ID NO: 536665 - RNA, 32 nt, Human
uuccucugcccauucucccuugccaagaggaa

SEQ ID NO: 536666 - RNA, 32 nt, Human
uuccucugccuguacuacccccagaugcuuua

SEQ ID NO: 536667 - RNA, 32 nt, Human
uuccucugcucacucuuuuccugcucccaggc

SEQ ID NO: 536668 - RNA, 32 nt, Human
uuccucugcuccugcccacucugcuuccaccc

SEQ ID NO: 536669 - RNA, 32 nt, Human
uuccucugcuccugcugaucugugccacugaa

SEQ ID NO: 536670 - RNA, 32 nt, Human
uuccucugcucggcucugucauccccugacug

SEQ ID NO: 536671 - RNA, 32 nt, Human
uuccucugcugacccagcugggagggggagga

SEQ ID NO: 536672 - RNA, 32 nt, Human
uuccucugcuuuuccuccuuuuuaccaucuac

SEQ ID NO: 536673 - RNA, 32 nt, Human
uuccucuggaaagagaagucacacagacaauc

SEQ ID NO: 536674 - RNA, 32 nt, Human
uuccucuggcccucuccaggguguuuuccacu

SEQ ID NO: 536675 - RNA, 32 nt, Human
uuccucugggaaacugacagcugucuuccaca

SEQ ID NO: 536676 - RNA, 32 nt, Human
uuccucugggagcucugugccacugagguaug

SEQ ID NO: 536677 - RNA, 32 nt, Human
uuccucugggcaggggacagagagacacaggc

SEQ ID NO: 536678 - RNA, 32 nt, Human
uuccucugggcccuggcugugggcagaggcca

SEQ ID NO: 536679 - RNA, 32 nt, Human
uuccucuguaccacucugcuuccuuggacaau

SEQ ID NO: 536680 - RNA, 32 nt, Human
uuccucugucgcaaggaagugcaagcggagcu

SEQ ID NO: 536681 - RNA, 32 nt, Human
uuccucuguggcugaggugggagggggagggu

SEQ ID NO: 536682 - RNA, 32 nt, Human
uuccucuguggggcauuggauccucccacagu

SEQ ID NO: 536683 - RNA, 32 nt, Human
uuccucugugucaggugacaugguggcacccc

SEQ ID NO: 536684 - RNA, 32 nt, Human
uuccucuguuacaaccucagcacuuugcaccg

SEQ ID NO: 536685 - RNA, 18 nt, Human
uuccucuucaauuuuccc

SEQ ID NO: 536686 - RNA, 32 nt, Human
uuccucuuccaccaccaccaccggcugcccag

SEQ ID NO: 536687 - RNA, 32 nt, Human
uuccucuuccaucucucugucaccucccuccc

SEQ ID NO: 536688 - RNA, 32 nt, Human
uuccucuucccaaucagccucuacccauucuc

SEQ ID NO: 536689 - RNA, 32 nt, Human
uuccucuucccagcuuugcagcagguccucaa

SEQ ID NO: 536690 - RNA, 32 nt, Human
uuccucuuccucuccaaaccaccucgaagcag

SEQ ID NO: 536691 - RNA, 32 nt, Human
uuccucuuccucucuuaaaacuaucuuagaug

SEQ ID NO: 536692 - RNA, 32 nt, Human
uuccucuuccuuucccuuccuucucuuuucuu

SEQ ID NO: 536693 - RNA, 32 nt, Human
uuccucuucguuaagucggccuucccaacaug

SEQ ID NO: 536694 - RNA, 18 nt, Human
uuccucuucucccuugcc

SEQ ID NO: 536695 - RNA, 32 nt, Human
uuccucuucugccagagguggagggaggguug

SEQ ID NO: 536696 - RNA, 32 nt, Human
uuccucuucuuuuuccucugaccucugugacu

SEQ ID NO: 536697 - RNA, 32 nt, Human
uuccucuuggcacuucugggugugucagucau

SEQ ID NO: 536698 - RNA, 32 nt, Human
uuccucuugggcuuucagcccagacuccaagc

SEQ ID NO: 536699 - RNA, 32 nt, Human
uuccucuuuauggcugaauaauacugcauugu

SEQ ID NO: 536700 - RNA, 32 nt, Human
uuccucuuuccucugcugcuuuccuuccuucu

SEQ ID NO: 536701 - RNA, 32 nt, Human
uuccucuuucuuuccguuuccaaaggagcaag

SEQ ID NO: 536702 - RNA, 32 nt, Human
uuccucuuuucuugcugacccuucggagcucu

SEQ ID NO: 536703 - RNA, 27 nt, Human
uuccugaaagccaggccucgggaccug

SEQ ID NO: 536704 - RNA, 32 nt, Human
uuccugaaaggccagaaguucaaagauggacu

SEQ ID NO: 536705 - RNA, 19 nt, Human
uuccugaaauaccuagaaa

SEQ ID NO: 536706 - RNA, 32 nt, Human
uuccugaacaugucacuccacagcagaggacc

SEQ ID NO: 536707 - RNA, 32 nt, Human
uuccugaacugggguuugggugcacugagacg

SEQ ID NO: 536708 - RNA, 32 nt, Human
uuccugaagcugaagaaagaguaaaagccagg

SEQ ID NO: 536709 - RNA, 32 nt, Human
uuccugaagggcccucccaaggcuacaucccc

SEQ ID NO: 536710 - RNA, 32 nt, Human
uuccugaagguggccaagucauuguguuccca

SEQ ID NO: 536711 - RNA, 32 nt, Human
uuccugaagugcugggauuacaggcaugagcc

SEQ ID NO: 536712 - RNA, 32 nt, Human
uuccugaaguguuuauuuucucucauauccac

SEQ ID NO: 536713 - RNA, 32 nt, Human
uuccugaauaagaggaggugaugcaaauguau

SEQ ID NO: 536714 - RNA, 32 nt, Human
uuccugaaucucuguccugccacacauggucc

SEQ ID NO: 536715 - RNA, 32 nt, Human
uuccugaaugcuaggcuggaaaguggugccug

SEQ ID NO: 536716 - RNA, 32 nt, Human
uuccugacaccuggaacugugcaccuggcacc

SEQ ID NO: 536717 - RNA, 32 nt, Human
uuccugacacuaccagccugggaggcccaggu

SEQ ID NO: 536718 - RNA, 32 nt, Human
uuccugaccccaaggucagaggagacuauaua

SEQ ID NO: 536719 - RNA, 32 nt, Human
uuccugacccuccgcugcagaggauugaggcu

SEQ ID NO: 536720 - RNA, 31 nt, Human
uuccugacccucucugggcugcagucaccuu

SEQ ID NO: 536721 - RNA, 32 nt, Human
uuccugaccucagugauccacccaccuuggcc

SEQ ID NO: 536722 - RNA, 32 nt, Human
uuccugaccucguguccgcccaccucagccuc

SEQ ID NO: 536723 - RNA, 32 nt, Human
uuccugacugcacuggccuggcagucuggcug

SEQ ID NO: 536724 - RNA, 32 nt, Human
uuccugacugcagcucucuucauucugccaac

SEQ ID NO: 536725 - RNA, 23 nt, Human
uuccugacuucuaucugggcuug

SEQ ID NO: 536726 - RNA, 32 nt, Human
uuccugacuugccuuuucccuugagaagggga

SEQ ID NO: 536727 - RNA, 32 nt, Human
uuccugagaacuccggccccaggcuggccuga

SEQ ID NO: 536728 - RNA, 32 nt, Human
uuccugagaagagauggaaguggagcugugac

SEQ ID NO: 536729 - RNA, 32 nt, Human
uuccugagaagugaaugagucaacagcuuuca

SEQ ID NO: 536730 - RNA, 32 nt, Human
uuccugagacaaauacucacugaagggcuugu

SEQ ID NO: 536731 - RNA, 32 nt, Human
uuccugagagcccagccucucccuccaguacu

SEQ ID NO: 536732 - RNA, 32 nt, Human
uuccugagagguggugggcaggagggaggagu

SEQ ID NO: 536733 - RNA, 32 nt, Human
uuccugagagucucacucugucacccaggcug

SEQ ID NO: 536734 - RNA, 24 nt, Human
uuccugagaucuacccggggcuug

SEQ ID NO: 536735 - RNA, 23 nt, Human
uuccugagaugacugaguaugga

SEQ ID NO: 536736 - RNA, 32 nt, Human
uuccugagcccaagcuauccuccugccucagc

SEQ ID NO: 536737 - RNA, 32 nt, Human
uuccugagccccaccugcuucauggguuggcu

SEQ ID NO: 536738 - RNA, 32 nt, Human
uuccugagcuaaagcgaucugcccaccucggc

SEQ ID NO: 536739 - RNA, 32 nt, Human
uuccugagcuaaauggaaaugauaucauccca

SEQ ID NO: 536740 - RNA, 32 nt, Human
uuccugagcugcauuaaaguugaaccacuagg

SEQ ID NO: 536741 - RNA, 32 nt, Human
uuccugagcuuggucccugccuggugauucuu

SEQ ID NO: 536742 - RNA, 32 nt, Human
uuccugaggagaaaagccagaguggagucugg

SEQ ID NO: 536743 - RNA, 32 nt, Human
uuccugaggagagggguguauccaggcuuacc

SEQ ID NO: 536744 - RNA, 32 nt, Human
uuccugaggauguagucaaggaagaaaaaguu

SEQ ID NO: 536745 - RNA, 32 nt, Human
uuccugaggcaugaaaauucucagggacaaag

SEQ ID NO: 536746 - RNA, 32 nt, Human
uuccugaggcugcccucuccagucccaggagc

SEQ ID NO: 536747 - RNA, 32 nt, Human
uuccugagggccagaggggagccccaggaccc

SEQ ID NO: 536748 - RNA, 32 nt, Human
uuccugagguucccuucaccccucucucuugc

SEQ ID NO: 536749 - RNA, 32 nt, Human
uuccugaguagcuaggacuacaagcaugugcc

SEQ ID NO: 536750 - RNA, 32 nt, Human
uuccugaguagcugggacuacaggcacccgcc

SEQ ID NO: 536751 - RNA, 32 nt, Human
uuccugaguagcugggaggacaggcaugcgcc

SEQ ID NO: 536752 - RNA, 32 nt, Human
uuccugaguagcugggauuacaggcagccacc

SEQ ID NO: 536753 - RNA, 32 nt, Human
uuccugaguagcugggauuacaggcgcccgcc

SEQ ID NO: 536754 - RNA, 32 nt, Human
uuccugaguagcugggauuacaggugcgcacc

SEQ ID NO: 536755 - RNA, 32 nt, Human
uuccugaguaggugggauuacaagcaugcacc

SEQ ID NO: 536756 - RNA, 32 nt, Human
uuccugaguaguugggaauacaggcaugcgcu

SEQ ID NO: 536757 - RNA, 32 nt, Human
uuccugagucaccccucuguccagccagcucc

SEQ ID NO: 536758 - RNA, 32 nt, Human
uuccugauccacccucuccucccaccucccac

SEQ ID NO: 536759 - RNA, 32 nt, Human
uuccugaucccccaccugucugaaaaguaccu

SEQ ID NO: 536760 - RNA, 32 nt, Human
uuccugaugaucuuuaaaauguggucacuaaa

SEQ ID NO: 536761 - RNA, 32 nt, Human
uuccugaugcugugugggucucuggcuccccc

SEQ ID NO: 536762 - RNA, 32 nt, Human
uuccugauucauucuucuugggcuuugcuagc

SEQ ID NO: 536763 - RNA, 23 nt, Human
uuccugauuccaccuaccuccua

SEQ ID NO: 536764 - RNA, 27 nt, Human
uuccugauucugagacuuugggacuug

SEQ ID NO: 536765 - RNA, 27 nt, Human
uuccugauucugaggcuuugggacuug

SEQ ID NO: 536766 - RNA, 32 nt, Human
uuccugauuguggcugagagagaugauuacug

SEQ ID NO: 536767 - RNA, 32 nt, Human
uuccugauuugaaaguuuguuuuuaaaaguuu

SEQ ID NO: 536768 - RNA, 21 nt, Human
uuccugcaaaguauuauugua

SEQ ID NO: 536769 - RNA, 23 nt, Human
uuccugcacggaccugggacuug

SEQ ID NO: 536770 - RNA, 32 nt, Human
uuccugcagacaccagcucuccuuccugccuu

SEQ ID NO: 536771 - RNA, 32 nt, Human
uuccugcagaggaucaagacagcacguggacc

SEQ ID NO: 536772 - RNA, 32 nt, Human
uuccugcagaggccucuuucugccuccauggc

SEQ ID NO: 536773 - RNA, 32 nt, Human
uuccugcagcagcugcugccacugcucagcgc

SEQ ID NO: 536774 - RNA, 32 nt, Human
uuccugcagcaugaaggagagcucugcuccca

SEQ ID NO: 536775 - RNA, 32 nt, Human
uuccugcagccuggugcucugcccugcacguc

SEQ ID NO: 536776 - RNA, 32 nt, Human
uuccugcaggagugcucaugagcccagaaugu

SEQ ID NO: 536777 - RNA, 32 nt, Human
uuccugcaggcaggaacaaacagggcugccuu

SEQ ID NO: 536778 - RNA, 32 nt, Human
uuccugcaggccaggccagcugccuccgcgug

SEQ ID NO: 536779 - RNA, 32 nt, Human
uuccugcagggaagcggcagcacacggagacc

SEQ ID NO: 536780 - RNA, 32 nt, Human
uuccugcagggagggaggagagaagggcggca

SEQ ID NO: 536781 - RNA, 32 nt, Human
uuccugcagguguuccaccugccuucggagcc

SEQ ID NO: 536782 - RNA, 32 nt, Human
uuccugcagucagaggauggcagcgggaaggg

SEQ ID NO: 536783 - RNA, 32 nt, Human
uuccugcaguuccagacaccucccacaauaaa

SEQ ID NO: 536784 - RNA, 32 nt, Human
uuccugcaucuucucacccccucaaccaggaa

SEQ ID NO: 536785 - RNA, 32 nt, Human
uuccugcauucuagucccugcugugcugcagg

SEQ ID NO: 536786 - RNA, 32 nt, Human
uuccugcauucugucuguccuuuuccuccuug

SEQ ID NO: 536787 - RNA, 32 nt, Human
uuccugcauuucucccucccuccuucccucgu

SEQ ID NO: 536788 - RNA, 32 nt, Human
uuccugcauuugugaagaauccuucaugacuu

SEQ ID NO: 536789 - RNA, 32 nt, Human
uuccugccaagccaccuuccagugagcucugg

SEQ ID NO: 536790 - RNA, 32 nt, Human
uuccugccaagccgagggcgacggagaucccc

SEQ ID NO: 536791 - RNA, 32 nt, Human
uuccugccagcaggaagccucugccugugcuc

SEQ ID NO: 536792 - RNA, 32 nt, Human
uuccugccagccugugcuugcggcagggagcc

SEQ ID NO: 536793 - RNA, 32 nt, Human
uuccugccaucuacaagaggagaggaccuggc

SEQ ID NO: 536794 - RNA, 32 nt, Human
uuccugcccaccuaaacccucguuuuaguaau

SEQ ID NO: 536795 - RNA, 32 nt, Human
uuccugcccagccugccaccaccgggccaugc

SEQ ID NO: 536796 - RNA, 32 nt, Human
uuccugcccaggccucucccaccaccaccuuc

SEQ ID NO: 536797 - RNA, 32 nt, Human
uuccugcccuggacggugucucagaacaugaa

SEQ ID NO: 536798 - RNA, 32 nt, Human
uuccugcccuggaugggaugugaguggggccc

SEQ ID NO: 536799 - RNA, 32 nt, Human
uuccugcccuucuccuuccucugcucccuugg

SEQ ID NO: 536800 - RNA, 31 nt, Human
uuccugcccuucugccugccugugucugcug

SEQ ID NO: 536801 - RNA, 32 nt, Human
uuccugcccuuuccuuccuuccuuuucucucu

SEQ ID NO: 536802 - RNA, 32 nt, Human
uuccugcccuuugcccagcccugggccuccaa

SEQ ID NO: 536803 - RNA, 32 nt, Human
uuccugccgggaggaaccucaguuggguaagg

SEQ ID NO: 536804 - RNA, 32 nt, Human
uuccugccguccuuuucccuuuaccauguccc

SEQ ID NO: 536805 - RNA, 32 nt, Human
uuccugccgugacuuucuccuccuggacacug

SEQ ID NO: 536806 - RNA, 32 nt, Human
uuccugccucagccucaugaauagcugggauu

SEQ ID NO: 536807 - RNA, 15 nt, Human
uuccugccucaggua

SEQ ID NO: 536808 - RNA, 32 nt, Human
uuccugccuccacccucuuucucgccgcgaag

SEQ ID NO: 536809 - RNA, 32 nt, Human
uuccugccuccaugccacuccagacugcaccg

SEQ ID NO: 536810 - RNA, 32 nt, Human
uuccugccuccggcucuugccucccagugcca

SEQ ID NO: 536811 - RNA, 22 nt, Human
uuccugccuccugccccacuca

SEQ ID NO: 536812 - RNA, 32 nt, Human
uuccugccuggaacucaucugugaacugggac

SEQ ID NO: 536813 - RNA, 32 nt, Human
uuccugccuggauuucuguucuugcaguugcc

SEQ ID NO: 536814 - RNA, 32 nt, Human
uuccugccuuagccuuagccuccugaguagcu

SEQ ID NO: 536815 - RNA, 32 nt, Human
uuccugccuuuugcaaucaugauaccuggcaa

SEQ ID NO: 536816 - RNA, 32 nt, Human
uuccugcgcuugcuuaguguugacauuugaau

SEQ ID NO: 536817 - RNA, 32 nt, Human
uuccugcggcaccaccucccuuuuuauauugc

SEQ ID NO: 536818 - RNA, 32 nt, Human
uuccugcgugccgcagcaaagcaggaauccaa

SEQ ID NO: 536819 - RNA, 32 nt, Human
uuccugcgugcucucccuuugaccugcuuggc

SEQ ID NO: 536820 - RNA, 32 nt, Human
uuccugcguuucuuccuccugcccugggucaa

SEQ ID NO: 536821 - RNA, 22 nt, Human
uuccugcuagcuucuuuuugca

SEQ ID NO: 536822 - RNA, 32 nt, Human
uuccugcucaaaaaccagcaaaauuaguguuu

SEQ ID NO: 536823 - RNA, 32 nt, Human
uuccugcucagcccuguuugcgcagauuaauc

SEQ ID NO: 536824 - RNA, 32 nt, Human
uuccugcuccaucccaccuggguuguaacuca

SEQ ID NO: 536825 - RNA, 32 nt, Human
uuccugcuccuccaccuccuccucuccuuguc

SEQ ID NO: 536826 - RNA, 32 nt, Human
uuccugcuccucccgcccuccccaccaccauc

SEQ ID NO: 536827 - RNA, 32 nt, Human
uuccugcucugcccuuuacaagcugugugacc

SEQ ID NO: 536828 - RNA, 32 nt, Human
uuccugcucuguucugggguccaaaccuuggu

SEQ ID NO: 536829 - RNA, 32 nt, Human
uuccugcucuucccucauuaaauugcuuuuaa

SEQ ID NO: 536830 - RNA, 32 nt, Human
uuccugcugcuuccagcuccaucccuacagac

SEQ ID NO: 536831 - RNA, 32 nt, Human
uuccugcugggguccugguuccucaggagaga

SEQ ID NO: 536832 - RNA, 32 nt, Human
uuccugcuggguggaugcagugguccaggacu

SEQ ID NO: 536833 - RNA, 32 nt, Human
uuccugcuguaucacaggaagugauuugcauu

SEQ ID NO: 536834 - RNA, 32 nt, Human
uuccugcugucccucagccuccaggcuucagu

SEQ ID NO: 536835 - RNA, 32 nt, Human
uuccugcuguuaauuguuagacugguugauga

SEQ ID NO: 536836 - RNA, 32 nt, Human
uuccugcuuaucaccugaacugugccaguauc

SEQ ID NO: 536837 - RNA, 32 nt, Human
uuccugcuuccacguccugacccccuggcccu

SEQ ID NO: 536838 - RNA, 32 nt, Human
uuccugcuuccucuauuuguuugccccaggaa

SEQ ID NO: 536839 - RNA, 32 nt, Human
uuccugcuucuggucuucuccugggcuccacu

SEQ ID NO: 536840 - RNA, 32 nt, Human
uuccugcuugaccacucgcacauggcucuagg

SEQ ID NO: 536841 - RNA, 32 nt, Human
uuccugcuugccaaggcagaggccugggcugg

SEQ ID NO: 536842 - RNA, 32 nt, Human
uuccugcuuguccuccccaaccgccuggccuu

SEQ ID NO: 536843 - RNA, 32 nt, Human
uuccuggaaagcuucauguugaaagaaccuau

SEQ ID NO: 536844 - RNA, 32 nt, Human
uuccuggaaaggcuccuuugggguucagaauc

SEQ ID NO: 536845 - RNA, 32 nt, Human
uuccuggaaccaggaauucauucucaguguag

SEQ ID NO: 536846 - RNA, 32 nt, Human
uuccuggaagaaaaggagaaaagggagaugag

SEQ ID NO: 536847 - RNA, 32 nt, Human
uuccuggaagcaggagaaagaugaggacuuug

SEQ ID NO: 536848 - RNA, 22 nt, Human
uuccuggaagccugcaguuggg

SEQ ID NO: 536849 - RNA, 23 nt, Human
uuccuggacacaggaaagacggg

SEQ ID NO: 536850 - RNA, 24 nt, Human
uuccuggacacgccucugagccgg

SEQ ID NO: 536851 - RNA, 32 nt, Human
uuccuggacagaaacauauccccaaacaccuc

SEQ ID NO: 536852 - RNA, 32 nt, Human
uuccuggacagugagagcagggcugggcgccu

SEQ ID NO: 536853 - RNA, 32 nt, Human
uuccuggacagugagagcagggcuuggcgccu

SEQ ID NO: 536854 - RNA, 22 nt, Human
uuccuggaccgggcagcacggg

SEQ ID NO: 536855 - RNA, 32 nt, Human
uuccuggacggggccagcggaggcagagccgg

SEQ ID NO: 536856 - RNA, 32 nt, Human
uuccuggacuauucaguagccacucagaugcc

SEQ ID NO: 536857 - RNA, 32 nt, Human
uuccuggacuauucaguagccacucagaugcu

SEQ ID NO: 536858 - RNA, 32 nt, Human
uuccuggacuccucaccuccaggaugagcacu

SEQ ID NO: 536859 - RNA, 23 nt, Human
uuccuggagaaagcagcugcaga

SEQ ID NO: 536860 - RNA, 32 nt, Human
uuccuggagcacugucugggaguuucaggagc

SEQ ID NO: 536861 - RNA, 32 nt, Human
uuccuggagcaucugcccuuugcuccuagcag

SEQ ID NO: 536862 - RNA, 32 nt, Human
uuccuggagcccagaggagggcagcagaaggg

SEQ ID NO: 536863 - RNA, 32 nt, Human
uuccuggagcucccagccagagcugagcuuag

SEQ ID NO: 536864 - RNA, 32 nt, Human
uuccuggagcuucugccgccuccuguggaaga

SEQ ID NO: 536865 - RNA, 32 nt, Human
uuccuggaggaauccgagaagagcagagcgga

SEQ ID NO: 536866 - RNA, 23 nt, Human
uuccuggaggacagcagcaugga

SEQ ID NO: 536867 - RNA, 32 nt, Human
uuccuggaggagguggagcugcagcugggacu

SEQ ID NO: 536868 - RNA, 23 nt, Human
uuccuggaggcgaugcagccagg

SEQ ID NO: 536869 - RNA, 32 nt, Human
uuccuggagggauggccagggaaggagaaaac

SEQ ID NO: 536870 - RNA, 32 nt, Human
uuccuggagggcccugggauggacucagagau

SEQ ID NO: 536871 - RNA, 32 nt, Human
uuccuggagguuugcagugaggugaggagagu

SEQ ID NO: 536872 - RNA, 32 nt, Human
uuccuggauauggacaagaacucaggacccaa

SEQ ID NO: 536873 - RNA, 32 nt, Human
uuccuggaucaauauucaaagacuggucauaa

SEQ ID NO: 536874 - RNA, 32 nt, Human
uuccuggaugagaaggaagucugggcugggca

SEQ ID NO: 536875 - RNA, 22 nt, Human
uuccuggauuuguaaauuguaa

SEQ ID NO: 536876 - RNA, 32 nt, Human
uuccuggcaaaguucugcucccugaagcagga

SEQ ID NO: 536877 - RNA, 32 nt, Human
uuccuggcaggcuucaagaacagcugcacaug

SEQ ID NO: 536878 - RNA, 32 nt, Human
uuccuggccacugauuucugcauggguagacc

SEQ ID NO: 536879 - RNA, 32 nt, Human
uuccuggccaguuucacaaucuagcucgacag

SEQ ID NO: 536880 - RNA, 32 nt, Human
uuccuggccauggagaggagaucuggacccga

SEQ ID NO: 536881 - RNA, 32 nt, Human
uuccuggccccagggcccuaauaaaccugcuu

SEQ ID NO: 536882 - RNA, 32 nt, Human
uuccuggcccugcucaguugccucuggaaguc

SEQ ID NO: 536883 - RNA, 32 nt, Human
uuccuggccuccacugccccaggacugaagug

SEQ ID NO: 536884 - RNA, 32 nt, Human
uuccuggccucuccaccaacuguacuucccaa

SEQ ID NO: 536885 - RNA, 32 nt, Human
uuccuggccugcccuccuccuccaggcagccu

SEQ ID NO: 536886 - RNA, 22 nt, Human
uuccuggcggcggcggcgcggg

SEQ ID NO: 536887 - RNA, 32 nt, Human
uuccuggcguaacuagaggagucccagugcag

SEQ ID NO: 536888 - RNA, 32 nt, Human
uuccuggcuaagcaggggcugacaggguggca

SEQ ID NO: 536889 - RNA, 32 nt, Human
uuccuggcucuccugcccacaggaugaacauu

SEQ ID NO: 536890 - RNA, 21 nt, Human
uuccuggcugagaugaugcuu

SEQ ID NO: 536891 - RNA, 32 nt, Human
uuccuggcugggugaccucaaccuaucacccu

SEQ ID NO: 536892 - RNA, 22 nt, Human
uuccuggcugugggaaucuuua

SEQ ID NO: 536893 - RNA, 26 nt, Human
uuccuggcuguucguguugggacuua

SEQ ID NO: 536894 - RNA, 32 nt, Human
uuccugggaaccuggauauugagcucuuacuu

SEQ ID NO: 536895 - RNA, 32 nt, Human
uuccugggagaaaccucccugggagaccaugg

SEQ ID NO: 536896 - RNA, 32 nt, Human
uuccugggaggcgggcgcggcaggacugggag

SEQ ID NO: 536897 - RNA, 24 nt, Human
uuccugggagucacugcagccaga

SEQ ID NO: 536898 - RNA, 32 nt, Human
uuccugggcaaagaagaaacggaggggaugaa

SEQ ID NO: 536899 - RNA, 32 nt, Human
uuccugggcagagggcagagugaggccaccug

SEQ ID NO: 536900 - RNA, 32 nt, Human
uuccugggccccaccaagacccaccaaaacca

SEQ ID NO: 536901 - RNA, 32 nt, Human
uuccugggcccuucccugggccucaggauccc

SEQ ID NO: 536902 - RNA, 24 nt, Human
uuccugggcuagccugcggucagg

SEQ ID NO: 536903 - RNA, 23 nt, Human
uuccugggcuaugcugccacaga

SEQ ID NO: 536904 - RNA, 32 nt, Human
uuccugggcucccagcccuaaaacucacugcc

SEQ ID NO: 536905 - RNA, 32 nt, Human
uuccugggcuccccuucucucuaccuucuccc

SEQ ID NO: 536906 - RNA, 32 nt, Human
uuccugggcucuauauuugauuuuggaaggca

SEQ ID NO: 536907 - RNA, 32 nt, Human
uuccugggcugaggacauggggauccaaggcc

SEQ ID NO: 536908 - RNA, 32 nt, Human
uuccugggcugcaggggagcaggaaaucuggg

SEQ ID NO: 536909 - RNA, 32 nt, Human
uuccuggggaauaaaaacuaccauuggaccua

SEQ ID NO: 536910 - RNA, 32 nt, Human
uuccuggggaauucacuucucuuccucccuca

SEQ ID NO: 536911 - RNA, 32 nt, Human
uuccuggggcaagagcaccaggcuccagggca

SEQ ID NO: 536912 - RNA, 32 nt, Human
uuccuggggcaggcggaaacaggcucacagau

SEQ ID NO: 536913 - RNA, 21 nt, Human
uuccuggggcgcgggcgcggg

SEQ ID NO: 536914 - RNA, 23 nt, Human
uuccuggggcuccggggcgcgga

SEQ ID NO: 536915 - RNA, 32 nt, Human
uuccuggggcugcagccagccugggacuuuug

SEQ ID NO: 536916 - RNA, 32 nt, Human
uuccugggggaucagacugugaagcaggaaga

SEQ ID NO: 536917 - RNA, 21 nt, Human
uuccugggggcagcagccggg

SEQ ID NO: 536918 - RNA, 32 nt, Human
uuccugggggccgaggaaguggggccacucug

SEQ ID NO: 536919 - RNA, 32 nt, Human
uuccugggggugacugaaugcccagccaggga

SEQ ID NO: 536920 - RNA, 32 nt, Human
uuccugggguacaagggcaggccagguaaggc

SEQ ID NO: 536921 - RNA, 32 nt, Human
uuccuggggugcuugugcccacuguguggaca

SEQ ID NO: 536922 - RNA, 32 nt, Human
uuccugggguggacucagaugggugggacaca

SEQ ID NO: 536923 - RNA, 32 nt, Human
uuccuggguagaagggaaaagacuggaaaaau

SEQ ID NO: 536924 - RNA, 32 nt, Human
uuccugggugcaccccucccccucucccgugc

SEQ ID NO: 536925 - RNA, 32 nt, Human
uuccugggugucuugcuugauuuucauaauag

SEQ ID NO: 536926 - RNA, 32 nt, Human
uuccuggguuccguggauucucuccuucuccu

SEQ ID NO: 536927 - RNA, 19 nt, Human
uuccuggguucuggcuccu

SEQ ID NO: 536928 - RNA, 32 nt, Human
uuccuggguugaauggggaccuggagaacuuu

SEQ ID NO: 536929 - RNA, 31 nt, Human
uuccugguaaugucucuccgaggugaaggcu

SEQ ID NO: 536930 - RNA, 32 nt, Human
uuccugguagccuccuuuccuccccuucugcc

SEQ ID NO: 536931 - RNA, 18 nt, Human
uuccugguagggaacugc

SEQ ID NO: 536932 - RNA, 21 nt, Human
uuccugguaguuugcguguaa

SEQ ID NO: 536933 - RNA, 32 nt, Human
uuccuggucccaaagccugguuggugaugguu

SEQ ID NO: 536934 - RNA, 32 nt, Human
uuccuggucccaggaccucugguggagggcca

SEQ ID NO: 536935 - RNA, 32 nt, Human
uuccugguccccaacguuuaucuagcuuguuu

SEQ ID NO: 536936 - RNA, 32 nt, Human
uuccuggucccuuuuugaggcaguagcaggua

SEQ ID NO: 536937 - RNA, 32 nt, Human
uuccuggucguuucucaaccugaggugcauag

SEQ ID NO: 536938 - RNA, 32 nt, Human
uuccuggucuucucccccagggucuugcucug

SEQ ID NO: 536939 - RNA, 32 nt, Human
uuccuggugagguugcguggguggauuaauuu

SEQ ID NO: 536940 - RNA, 19 nt, Human
uuccuggugcaguauuuca

SEQ ID NO: 536941 - RNA, 24 nt, Human
uuccugguggcuuuguuuacacug

SEQ ID NO: 536942 - RNA, 32 nt, Human
uuccuggugggagcugaagcacugggcuucca

SEQ ID NO: 536943 - RNA, 32 nt, Human
uuccugguguuuggauggucagcugggagugu

SEQ ID NO: 536944 - RNA, 32 nt, Human
uuccugguucaagugauucuccugccucagcc

SEQ ID NO: 536945 - RNA, 22 nt, Human
uuccugguuccagaaagggcug

SEQ ID NO: 536946 - RNA, 32 nt, Human
uuccugguugcaaccucucuuccucugggacu

SEQ ID NO: 536947 - RNA, 32 nt, Human
uuccugguugcccuuuuggaaugugauccugu

SEQ ID NO: 536948 - RNA, 32 nt, Human
uuccugguuguauguggccuguuuacaugaug

SEQ ID NO: 536949 - RNA, 32 nt, Human
uuccugguuuaugacuuucggcuuuguggaau

SEQ ID NO: 536950 - RNA, 21 nt, Human
uuccuguaagcagauguuuua

SEQ ID NO: 536951 - RNA, 32 nt, Human
uuccuguacaaacagugcacacacaugaacau

SEQ ID NO: 536952 - RNA, 32 nt, Human
uuccuguacagccuguggaacugugacuuuuc

SEQ ID NO: 536953 - RNA, 32 nt, Human
uuccuguaucuauuuuccucuauuuccuauca

SEQ ID NO: 536954 - RNA, 32 nt, Human
uuccuguauucacccguccagaccuuguucac

SEQ ID NO: 536955 - RNA, 32 nt, Human
uuccuguauuuuuaguagagacaggguuucac

SEQ ID NO: 536956 - RNA, 32 nt, Human
uuccugucacccaggcuggaguacaguggcgu

SEQ ID NO: 536957 - RNA, 32 nt, Human
uuccugucaccugcugagcuuucccaguguca

SEQ ID NO: 536958 - RNA, 32 nt, Human
uuccuguccccauguuucucugaggccuggca

SEQ ID NO: 536959 - RNA, 32 nt, Human
uuccugucccucucucccuuuguugggcaaag

SEQ ID NO: 536960 - RNA, 31 nt, Human
uuccugucccucucugagccuucacuuccuc

SEQ ID NO: 536961 - RNA, 32 nt, Human
uuccuguccuucuccccucccagcuccuggcg

SEQ ID NO: 536962 - RNA, 32 nt, Human
uuccugucgagugggcugggccacgcugacca

SEQ ID NO: 536963 - RNA, 32 nt, Human
uuccugucuauauaaaacaaguuucauauucg

SEQ ID NO: 536964 - RNA, 32 nt, Human
uuccugucucucuuccccuccucucucucuuc

SEQ ID NO: 536965 - RNA, 23 nt, Human
uuccugucugcgcugcgggcagg

SEQ ID NO: 536966 - RNA, 32 nt, Human
uuccugucuguauguggaauggaaggaccgug

SEQ ID NO: 536967 - RNA, 32 nt, Human
uuccugucuuauccuccaccgucuuucuuuua

SEQ ID NO: 536968 - RNA, 32 nt, Human
uuccugugaagcggucucuucuccccaggccc

SEQ ID NO: 536969 - RNA, 32 nt, Human
uuccugugaagugacagguguggacccugagg

SEQ ID NO: 536970 - RNA, 31 nt, Human
uuccugugacuucuuacuuugaugaagugca

SEQ ID NO: 536971 - RNA, 32 nt, Human
uuccugugaucucgcccugccuccacuugccu

SEQ ID NO: 536972 - RNA, 32 nt, Human
uuccugugcauuccaaguguugccugcaugcc

SEQ ID NO: 536973 - RNA, 32 nt, Human
uuccugugcccugugguaguuggaaacaaauc

SEQ ID NO: 536974 - RNA, 23 nt, Human
uuccugugccuaccuggggcuug

SEQ ID NO: 536975 - RNA, 32 nt, Human
uuccugugccugcgcuucuucucccccgccau

SEQ ID NO: 536976 - RNA, 32 nt, Human
uuccugugccuuauuguuucucccucuucucu

SEQ ID NO: 536977 - RNA, 23 nt, Human
uuccugugcuuuugugauuccaa

SEQ ID NO: 536978 - RNA, 32 nt, Human
uuccuguggaaggcagaggcagugagggaggu

SEQ ID NO: 536979 - RNA, 32 nt, Human
uuccuguggagauaagcccugccccucguucc

SEQ ID NO: 536980 - RNA, 32 nt, Human
uuccuguggcugggagcagcagcuccugaagg

SEQ ID NO: 536981 - RNA, 32 nt, Human
uuccugugggcaaccacaccacugccuggcgc

SEQ ID NO: 536982 - RNA, 32 nt, Human
uuccugugggcagaagggcugaggaagauggc

SEQ ID NO: 536983 - RNA, 32 nt, Human
uuccugugggcccugcugaacugugguuuggg

SEQ ID NO: 536984 - RNA, 32 nt, Human
uuccuguguaguuuacacccagagcagauacu

SEQ ID NO: 536985 - RNA, 32 nt, Human
uuccugugugagccaccacacccagccugggu

SEQ ID NO: 536986 - RNA, 32 nt, Human
uuccuguguguagacuguggccuggccuucgg

SEQ ID NO: 536987 - RNA, 32 nt, Human
uuccuguguguuucaggcauucacagauaaac

SEQ ID NO: 536988 - RNA, 32 nt, Human
uuccuguuaagccuguggaacugugaguccaa

SEQ ID NO: 536989 - RNA, 32 nt, Human
uuccuguucacagauaaagaaagaaagaaaua

SEQ ID NO: 536990 - RNA, 32 nt, Human
uuccuguucagcucccugugcgacccuccagg

SEQ ID NO: 536991 - RNA, 32 nt, Human
uuccuguucauuuuaaggaaaccuacuaaauc

SEQ ID NO: 536992 - RNA, 32 nt, Human
uuccuguuccccuuuuucaucuccuguauccu

SEQ ID NO: 536993 - RNA, 32 nt, Human
uuccuguucccuccccuccccuuccuguccuu

SEQ ID NO: 536994 - RNA, 32 nt, Human
uuccuguugcacccagugaucucuccggccuc

SEQ ID NO: 536995 - RNA, 32 nt, Human
uuccuguuggccccagcugcacucgcagggcc

SEQ ID NO: 536996 - RNA, 32 nt, Human
uuccuguuguacucugaauuucucucccuacc

SEQ ID NO: 536997 - RNA, 20 nt, Human
uuccuguuuccuguacaaug

SEQ ID NO: 536998 - RNA, 32 nt, Human
uuccuguuuggauuagaccauaguugacccau

SEQ ID NO: 536999 - RNA, 32 nt, Human
uuccuuaaaagauacgugccggggccaggugu

SEQ ID NO: 537000 - RNA, 24 nt, Human
uuccuuaaauaaaguaaaaaugac

SEQ ID NO: 537001 - RNA, 32 nt, Human
uuccuuaacagagggcaucauggaugcugggu

SEQ ID NO: 537002 - RNA, 32 nt, Human
uuccuuaacucucccuuccuggaaccgaaaug

SEQ ID NO: 537003 - RNA, 32 nt, Human
uuccuuaagcagcuggcucugggaaggucuca

SEQ ID NO: 537004 - RNA, 32 nt, Human
uuccuuaagccuugauuuccugaagcucucuc

SEQ ID NO: 537005 - RNA, 32 nt, Human
uuccuuacuucccagccccaccuucuaguucu

SEQ ID NO: 537006 - RNA, 32 nt, Human
uuccuuagacuggcggcuaccccgccacuggc

SEQ ID NO: 537007 - RNA, 32 nt, Human
uuccuuagagaccacuucauuaucuaaaagau

SEQ ID NO: 537008 - RNA, 32 nt, Human
uuccuuagagagagauggauuuuuguuggcaa

SEQ ID NO: 537009 - RNA, 32 nt, Human
uuccuuagagccugaguggugugaggugacag

SEQ ID NO: 537010 - RNA, 32 nt, Human
uuccuuagccuccugaguagcugggauuacag

SEQ ID NO: 537011 - RNA, 32 nt, Human
uuccuuagcuggaagccagggcuggaagcuac

SEQ ID NO: 537012 - RNA, 32 nt, Human
uuccuuagggcagugccucuagcuguguccuc

SEQ ID NO: 537013 - RNA, 32 nt, Human
uuccuuagucaggguucccugaaggaaugagg

SEQ ID NO: 537014 - RNA, 32 nt, Human
uuccuuagugagcuccacauuacuugauggua

SEQ ID NO: 537015 - RNA, 32 nt, Human
uuccuuaguucagagccugcaaaugaucacug

SEQ ID NO: 537016 - RNA, 32 nt, Human
uuccuuauaucuucuuguuagacaucuucugu

SEQ ID NO: 537017 - RNA, 32 nt, Human
uuccuuaucuugaaucuugcucugucacccag

SEQ ID NO: 537018 - RNA, 32 nt, Human
uuccuuaugguccugcuccuucugcugucaga

SEQ ID NO: 537019 - RNA, 32 nt, Human
uuccuuauucaacaugagaaagcucaugggca

SEQ ID NO: 537020 - RNA, 32 nt, Human
uuccuuauuuccuuuaguuuccuuccuuagcc

SEQ ID NO: 537021 - RNA, 32 nt, Human
uuccuucaaacaauggggugcuuccaaaccgg

SEQ ID NO: 537022 - RNA, 32 nt, Human
uuccuucaacguccacauuccaggugaccaca

SEQ ID NO: 537023 - RNA, 32 nt, Human
uuccuucaacuggcuacugagucaugauccuu

SEQ ID NO: 537024 - RNA, 32 nt, Human
uuccuucacaccaauucuccuccugagacgga

SEQ ID NO: 537025 - RNA, 31 nt, Human
uuccuucacagcuaugaauaagcuuucaggu

SEQ ID NO: 537026 - RNA, 32 nt, Human
uuccuucacagcuuugcuuuucugccucuucu

SEQ ID NO: 537027 - RNA, 32 nt, Human
uuccuucacccaccaucccccuaaccucggca

SEQ ID NO: 537028 - RNA, 32 nt, Human
uuccuucacuucucagugcugccugugaugag

SEQ ID NO: 537029 - RNA, 32 nt, Human
uuccuucagcuguguaucccagacuguuaaua

SEQ ID NO: 537030 - RNA, 32 nt, Human
uuccuucaggaguugaucucuaaugcuucuga

SEQ ID NO: 537031 - RNA, 32 nt, Human
uuccuucaggccuggcggcggcuuccaagcua

SEQ ID NO: 537032 - RNA, 32 nt, Human
uuccuucagugagcagaaucacuguggucagu

SEQ ID NO: 537033 - RNA, 32 nt, Human
uuccuucauaaaacauguaacacugaucuuca

SEQ ID NO: 537034 - RNA, 32 nt, Human
uuccuucauccucuuguuccuaaggaaacaaa

SEQ ID NO: 537035 - RNA, 28 nt, Human
uuccuucaugaacaucccccucccaaca

SEQ ID NO: 537036 - RNA, 32 nt, Human
uuccuucauggagccugcuucauguggaggaa

SEQ ID NO: 537037 - RNA, 32 nt, Human
uuccuucauggaggcucuggggaagaaucugc

SEQ ID NO: 537038 - RNA, 32 nt, Human
uuccuucauucaacccaccugcgucucauacu

SEQ ID NO: 537039 - RNA, 32 nt, Human
uuccuuccacuuacccacuaccucucacgcug

SEQ ID NO: 537040 - RNA, 32 nt, Human
uuccuuccagagagcacagagugggagguagg

SEQ ID NO: 537041 - RNA, 32 nt, Human
uuccuuccaguauucuauuuaaguaccuacua

SEQ ID NO: 537042 - RNA, 31 nt, Human
uuccuuccagugagagaaaaauagaauggua

SEQ ID NO: 537043 - RNA, 32 nt, Human
uuccuuccaucuuccucucuuagaucagcugg

SEQ ID NO: 537044 - RNA, 32 nt, Human
uuccuucccacugccaaaggccuguguugaga

SEQ ID NO: 537045 - RNA, 32 nt, Human
uuccuucccagcacucccagccugggauaagc

SEQ ID NO: 537046 - RNA, 32 nt, Human
uuccuucccauggauaggaagggacucugugu

SEQ ID NO: 537047 - RNA, 19 nt, Human
uuccuuccccaccccugcc

SEQ ID NO: 537048 - RNA, 32 nt, Human
uuccuucccccuggccugagggugggugggga

SEQ ID NO: 537049 - RNA, 32 nt, Human
uuccuuccccuccacccucccccacaaaauuc

SEQ ID NO: 537050 - RNA, 32 nt, Human
uuccuuccccugcaccuggccugggccacacc

SEQ ID NO: 537051 - RNA, 32 nt, Human
uuccuucccuggaguguagaccuguguguggg

SEQ ID NO: 537052 - RNA, 32 nt, Human
uuccuucccuggcacacugcauaacaccaguc

SEQ ID NO: 537053 - RNA, 32 nt, Human
uuccuucccuuucccuuucuuccugacuagcc

SEQ ID NO: 537054 - RNA, 32 nt, Human
uuccuucccuuuccucuugcuguuuccuuccu

SEQ ID NO: 537055 - RNA, 32 nt, Human
uuccuucccuuuucuuuucuuuucuuucuacu

SEQ ID NO: 537056 - RNA, 32 nt, Human
uuccuuccguccucaauuucuaccuccauaga

SEQ ID NO: 537057 - RNA, 32 nt, Human
uuccuuccuagagcuucaguguguuucuugug

SEQ ID NO: 537058 - RNA, 32 nt, Human
uuccuuccuauacauuguuuacacuucaacua

SEQ ID NO: 537059 - RNA, 32 nt, Human
uuccuuccucaccuggcucugccucccccgug

SEQ ID NO: 537060 - RNA, 32 nt, Human
uuccuuccuccagggcuuggggcuccugccca

SEQ ID NO: 537061 - RNA, 32 nt, Human
uuccuuccuccccuggcucccgcccucccucu

SEQ ID NO: 537062 - RNA, 32 nt, Human
uuccuuccucccuuccuucccuucccucccuu

SEQ ID NO: 537063 - RNA, 32 nt, Human
uuccuuccucuguccggagaggcacagguguc

SEQ ID NO: 537064 - RNA, 32 nt, Human
uuccuuccucuuuaucccuccuguuuuacuuu

SEQ ID NO: 537065 - RNA, 32 nt, Human
uuccuuccugagaacagucuugcucuugccau

SEQ ID NO: 537066 - RNA, 32 nt, Human
uuccuuccugauguggaauuguacauuuaaag

SEQ ID NO: 537067 - RNA, 32 nt, Human
uuccuuccugcgcuucuuccccaaagcucuua

SEQ ID NO: 537068 - RNA, 32 nt, Human
uuccuuccugugucccagagcuucacuggugg

SEQ ID NO: 537069 - RNA, 32 nt, Human
uuccuuccuuccccaacuccccaaacacugug

SEQ ID NO: 537070 - RNA, 32 nt, Human
uuccuuccuucccccuccucccccuccuuucc

SEQ ID NO: 537071 - RNA, 32 nt, Human
uuccuuccuucuuccucucuuagaccagcuuc

SEQ ID NO: 537072 - RNA, 32 nt, Human
uuccuucgccgcucccuccuguccccacucag

SEQ ID NO: 537073 - RNA, 32 nt, Human
uuccuucggucgucccgaauccggguucaucc

SEQ ID NO: 537074 - RNA, 32 nt, Human
uuccuucuaaggguucaucuucuaugcagucu

SEQ ID NO: 537075 - RNA, 32 nt, Human
uuccuucuacccacuuuagguuccuuggcugg

SEQ ID NO: 537076 - RNA, 32 nt, Human
uuccuucuagaaggagcuuccugacuggaacc

SEQ ID NO: 537077 - RNA, 32 nt, Human
uuccuucuagucuauuucagccuagaagaaaa

SEQ ID NO: 537078 - RNA, 32 nt, Human
uuccuucucaugcgccucuccgaaucacaccc

SEQ ID NO: 537079 - RNA, 32 nt, Human
uuccuucuccaaagcugggagucauguugccu

SEQ ID NO: 537080 - RNA, 32 nt, Human
uuccuucuccaaaggcuuggaguuuucuucug

SEQ ID NO: 537081 - RNA, 32 nt, Human
uuccuucuccacucucuccaugcccuggagaa

SEQ ID NO: 537082 - RNA, 32 nt, Human
uuccuucuccauccacacuggucccaaaugcc

SEQ ID NO: 537083 - RNA, 32 nt, Human
uuccuucuccauucccacugcuucacuugccu

SEQ ID NO: 537084 - RNA, 32 nt, Human
uuccuucucccugcaaccucaguccaaggaac

SEQ ID NO: 537085 - RNA, 32 nt, Human
uuccuucuccucaucccuccccaaaacaagaa

SEQ ID NO: 537086 - RNA, 32 nt, Human
uuccuucuccucuuccucuucuucuucuuccu

SEQ ID NO: 537087 - RNA, 32 nt, Human
uuccuucucuccaucauagucugggugccagc

SEQ ID NO: 537088 - RNA, 32 nt, Human
uuccuucucucccuuauccuuguucaagggcc

SEQ ID NO: 537089 - RNA, 32 nt, Human
uuccuucucucccuuucucauucucauuccac

SEQ ID NO: 537090 - RNA, 32 nt, Human
uuccuucugauucugccugaauagcugagagg

SEQ ID NO: 537091 - RNA, 32 nt, Human
uuccuucugcagcccuccuucugggcacuaag

SEQ ID NO: 537092 - RNA, 32 nt, Human
uuccuucugcccacccgcccuucuucccucug

SEQ ID NO: 537093 - RNA, 32 nt, Human
uuccuucugggcugucuccaucugacccuacc

SEQ ID NO: 537094 - RNA, 32 nt, Human
uuccuucuuacugcccuguccucugccuugga

SEQ ID NO: 537095 - RNA, 32 nt, Human
uuccuucuucaaggaucaaauguuuauugggg

SEQ ID NO: 537096 - RNA, 32 nt, Human
uuccuucuucauuuucgugccuggagugccuu

SEQ ID NO: 537097 - RNA, 19 nt, Human
uuccuucuuccuucucccg

SEQ ID NO: 537098 - RNA, 32 nt, Human
uuccuucuucuuuacuuacuggcaucagcaca

SEQ ID NO: 537099 - RNA, 32 nt, Human
uuccuucuuggucagagguagcugcagagggg

SEQ ID NO: 537100 - RNA, 32 nt, Human
uuccuucuuuacaaaaccaucauuucaacaug

SEQ ID NO: 537101 - RNA, 32 nt, Human
uuccuucuuuccccuuuugucuugcccacucc

SEQ ID NO: 537102 - RNA, 32 nt, Human
uuccuucuuuuuagaacccuguauuuaaacaa

SEQ ID NO: 537103 - RNA, 31 nt, Human
uuccuugaaacaugcaugcauuuaaaaauaa

SEQ ID NO: 537104 - RNA, 32 nt, Human
uuccuugaaaggcucaagacuguagcauggug

SEQ ID NO: 537105 - RNA, 32 nt, Human
uuccuugaacccaggagguggagguugcagug

SEQ ID NO: 537106 - RNA, 32 nt, Human
uuccuugagagaaaccgcugucauuaauaaaa

SEQ ID NO: 537107 - RNA, 32 nt, Human
uuccuugagauugucuuggcauggcccagccc

SEQ ID NO: 537108 - RNA, 32 nt, Human
uuccuugagcagaaaagagcacugagagcacu

SEQ ID NO: 537109 - RNA, 32 nt, Human
uuccuugagccacccuucccaccccagcccuu

SEQ ID NO: 537110 - RNA, 32 nt, Human
uuccuugaggcugauagcuagggcuugaccag

SEQ ID NO: 537111 - RNA, 32 nt, Human
uuccuugaggucagaggucaggagcagggcug

SEQ ID NO: 537112 - RNA, 32 nt, Human
uuccuugaggucccuuggggcagcaguuaaag

SEQ ID NO: 537113 - RNA, 32 nt, Human
uuccuugagucagugcuguugaugacgaguug

SEQ ID NO: 537114 - RNA, 32 nt, Human
uuccuugagugugggggauuugggugaaugag

SEQ ID NO: 537115 - RNA, 32 nt, Human
uuccuugaugagcucauggagcuugagaucuu

SEQ ID NO: 537116 - RNA, 32 nt, Human
uuccuugauucaguccuugacaaggaaucucc

SEQ ID NO: 537117 - RNA, 32 nt, Human
uuccuugcaaccacccuuggaccugacucagc

SEQ ID NO: 537118 - RNA, 32 nt, Human
uuccuugcauuuuccuaauaugccuuuacuga

SEQ ID NO: 537119 - RNA, 32 nt, Human
uuccuugccacuggucucaaagcugggcagcc

SEQ ID NO: 537120 - RNA, 32 nt, Human
uuccuugccaggccuguuuccccaccaggaaa

SEQ ID NO: 537121 - RNA, 32 nt, Human
uuccuugcccacuguuucuuccuuucugugcc

SEQ ID NO: 537122 - RNA, 32 nt, Human
uuccuugccuccuucuuuccucccucucucug

SEQ ID NO: 537123 - RNA, 32 nt, Human
uuccuugccugagaucaccuagaaaggaaccc

SEQ ID NO: 537124 - RNA, 32 nt, Human
uuccuugccugggaaucugucccaggaagagc

SEQ ID NO: 537125 - RNA, 32 nt, Human
uuccuugcugucaucuggcuugaguucugagg

SEQ ID NO: 537126 - RNA, 32 nt, Human
uuccuugcuuccuuccuuccucucuuucuguu

SEQ ID NO: 537127 - RNA, 32 nt, Human
uuccuugcuuucucuucuaauggaauaugcgu

SEQ ID NO: 537128 - RNA, 32 nt, Human
uuccuuggaacacauaagaacugugcaguagc

SEQ ID NO: 537129 - RNA, 32 nt, Human
uuccuuggagaagggcccuccugcagcuggac

SEQ ID NO: 537130 - RNA, 32 nt, Human
uuccuuggagacuggcccugcauucaggcagg

SEQ ID NO: 537131 - RNA, 32 nt, Human
uuccuuggagcagccucuucuggcagaaagcc

SEQ ID NO: 537132 - RNA, 32 nt, Human
uuccuuggcaucuccccacugcuccucucuuu

SEQ ID NO: 537133 - RNA, 32 nt, Human
uuccuuggcucaguuguguuuguauuuccuuu

SEQ ID NO: 537134 - RNA, 32 nt, Human
uuccuugggaggcggaauucgucugaaucgcu

SEQ ID NO: 537135 - RNA, 32 nt, Human
uuccuugggaggcugaggcgggagaauugcuu

SEQ ID NO: 537136 - RNA, 32 nt, Human
uuccuuggggacaagggugguuggcagcucca

SEQ ID NO: 537137 - RNA, 32 nt, Human
uuccuuggggcagagggaguuucagacaagac

SEQ ID NO: 537138 - RNA, 32 nt, Human
uuccuuggguguuacaugagccaagcccucac

SEQ ID NO: 537139 - RNA, 32 nt, Human
  misc_feature (9)..(9): n is a, c, g or u
uuccuuggnagggaaagggaaggguuggggga

SEQ ID NO: 537140 - RNA, 32 nt, Human
uuccuugguauccaacuuaaaucccagaauuu

SEQ ID NO: 537141 - RNA, 32 nt, Human
uuccuugguauggugacagugucucuccaugg

SEQ ID NO: 537142 - RNA, 32 nt, Human
uuccuuggugaggacuccaagaacucacugau

SEQ ID NO: 537143 - RNA, 32 nt, Human
uuccuuggugccacugaccacagcucuuucuu

SEQ ID NO: 537144 - RNA, 32 nt, Human
uuccuugguuccuguggaaugcaucugggaag

SEQ ID NO: 537145 - RNA, 32 nt, Human
uuccuugguuguacagguguacauuuguaaac

SEQ ID NO: 537146 - RNA, 20 nt, Human
uuccuugguuugugacugca

SEQ ID NO: 537147 - RNA, 32 nt, Human
uuccuuguccccuccuccuccuuguccaucuc

SEQ ID NO: 537148 - RNA, 32 nt, Human
uuccuuguccugcuuauucuuuuguucuugaa

SEQ ID NO: 537149 - RNA, 32 nt, Human
uuccuugucugccuccugcugcuucuguaacu

SEQ ID NO: 537150 - RNA, 32 nt, Human
uuccuugucugccuuuacagauguuuccucuu

SEQ ID NO: 537151 - RNA, 20 nt, Human
uuccuugucuggaaaggguu

SEQ ID NO: 537152 - RNA, 32 nt, Human
uuccuugugggauuggaccagcauuccucaag

SEQ ID NO: 537153 - RNA, 32 nt, Human
uuccuugugguccugcuccuucugcugucaga

SEQ ID NO: 537154 - RNA, 32 nt, Human
uuccuuguuucugcucagcccagaugcacaga

SEQ ID NO: 537155 - RNA, 32 nt, Human
uuccuuuaaaaaccuuugucaggcugggcgcg

SEQ ID NO: 537156 - RNA, 32 nt, Human
uuccuuuaacagcaaaaggaaagagagguucu

SEQ ID NO: 537157 - RNA, 32 nt, Human
uuccuuuaaugucuuucuaaguugaagggcag

SEQ ID NO: 537158 - RNA, 32 nt, Human
uuccuuuacugucucuccuuuucugaccauua

SEQ ID NO: 537159 - RNA, 32 nt, Human
uuccuuuauccugaguacugggauuacaggcg

SEQ ID NO: 537160 - RNA, 32 nt, Human
uuccuuucacugcauuuuccaccaacagucau

SEQ ID NO: 537161 - RNA, 32 nt, Human
uuccuuucacuuucacacuucaucucauuccu

SEQ ID NO: 537162 - RNA, 32 nt, Human
uuccuuucauuuccccagccuaggcaagggug

SEQ ID NO: 537163 - RNA, 32 nt, Human
uuccuuuccaacccuuucaucccugugcagcc

SEQ ID NO: 537164 - RNA, 32 nt, Human
uuccuuuccagccucacgcccgugggcugcag

SEQ ID NO: 537165 - RNA, 32 nt, Human
uuccuuuccaggaagggaggcaggagcacccg

SEQ ID NO: 537166 - RNA, 32 nt, Human
uuccuuuccccuucccuucccuucccuuccau

SEQ ID NO: 537167 - RNA, 32 nt, Human
uuccuuucccgcauucagacccugcagacacu

SEQ ID NO: 537168 - RNA, 32 nt, Human
uuccuuucccuuucuuuccuuuuucccugucc

SEQ ID NO: 537169 - RNA, 32 nt, Human
uuccuuuccguguuccccaacaaccucaugcu

SEQ ID NO: 537170 - RNA, 32 nt, Human
uuccuuuccucccucccucugccauccuucau

SEQ ID NO: 537171 - RNA, 32 nt, Human
uuccuuuccucuugaccuucuuuccaucuuuc

SEQ ID NO: 537172 - RNA, 22 nt, Human
uuccuuuccugugaaaagguug

SEQ ID NO: 537173 - RNA, 32 nt, Human
uuccuuuccuuaccuuguuucuucccagaaaa

SEQ ID NO: 537174 - RNA, 32 nt, Human
uuccuuuccuucacuucccuuuuaaccccuag

SEQ ID NO: 537175 - RNA, 32 nt, Human
uuccuuuccuugugguugaaaccacagucagu

SEQ ID NO: 537176 - RNA, 32 nt, Human
uuccuuuccuuuccuuuccucuccugcccauu

SEQ ID NO: 537177 - RNA, 32 nt, Human
uuccuuuccuuuccuuucuuucuuccuuuccu

SEQ ID NO: 537178 - RNA, 32 nt, Human
uuccuuuccuuugaccuaauggagcuagaaau

SEQ ID NO: 537179 - RNA, 32 nt, Human
uuccuuucucaaaucagcaaauucucucugag

SEQ ID NO: 537180 - RNA, 32 nt, Human
uuccuuucucaccuccuccuccacucccugcc

SEQ ID NO: 537181 - RNA, 32 nt, Human
uuccuuucuccuccucucauccuacacacacu

SEQ ID NO: 537182 - RNA, 32 nt, Human
uuccuuucucuccacaccucccaaacccgcug

SEQ ID NO: 537183 - RNA, 32 nt, Human
uuccuuucugcccuuuucccuagagauaaggu

SEQ ID NO: 537184 - RNA, 32 nt, Human
uuccuuucugcugccugaugucucaauggcuu

SEQ ID NO: 537185 - RNA, 32 nt, Human
uuccuuucugcuuuucugaaugcaucaagggu

SEQ ID NO: 537186 - RNA, 32 nt, Human
uuccuuucuucuugugacaaaacaucuuucaa

SEQ ID NO: 537187 - RNA, 32 nt, Human
uuccuuucuugcaaauugcuuuguguguucaa

SEQ ID NO: 537188 - RNA, 32 nt, Human
uuccuuucuuuccuuuuucuugucuuguuucu

SEQ ID NO: 537189 - RNA, 32 nt, Human
uuccuuucuuucucugaauuacugcuuuuucu

SEQ ID NO: 537190 - RNA, 22 nt, Human
uuccuuucuuuuccauccaaca

SEQ ID NO: 537191 - RNA, 32 nt, Human
uuccuuugaaagccagaacaauggaucggcuu

SEQ ID NO: 537192 - RNA, 32 nt, Human
uuccuuugacaaauuccuuuuccucuuaguuu

SEQ ID NO: 537193 - RNA, 32 nt, Human
uuccuuugagcagucuccuuuuacuuaugcac

SEQ ID NO: 537194 - RNA, 32 nt, Human
uuccuuugaguggugacccagcucuuugccuu

SEQ ID NO: 537195 - RNA, 32 nt, Human
uuccuuugaugugaaguacaugaauuuuuccu

SEQ ID NO: 537196 - RNA, 32 nt, Human
uuccuuugauugguccuugagugaccagagac

SEQ ID NO: 537197 - RNA, 32 nt, Human
uuccuuugccaaccuccguucuauuuaugugc

SEQ ID NO: 537198 - RNA, 32 nt, Human
uuccuuugccuaaaucucuccacuuauucuuu

SEQ ID NO: 537199 - RNA, 32 nt, Human
uuccuuugccugaagcuguuuugggaaggguc

SEQ ID NO: 537200 - RNA, 22 nt, Human
uuccuuugcucuuucccccuuc

SEQ ID NO: 537201 - RNA, 32 nt, Human
uuccuuugcuuaugccccaacccuuggcuauc

SEQ ID NO: 537202 - RNA, 32 nt, Human
uuccuuuggcuuugcauggcuuuucuucaggu

SEQ ID NO: 537203 - RNA, 32 nt, Human
uuccuuuggggugggaggauggcgggggcagg

SEQ ID NO: 537204 - RNA, 22 nt, Human
uuccuuugguacaaaaggguug

SEQ ID NO: 537205 - RNA, 32 nt, Human
uuccuuugguccugucuugcaucugucuugaa

SEQ ID NO: 537206 - RNA, 32 nt, Human
uuccuuuggucuucacucuaaucccuggaguu

SEQ ID NO: 537207 - RNA, 32 nt, Human
uuccuuuguauacuuguccuuccucccauuuc

SEQ ID NO: 537208 - RNA, 32 nt, Human
uuccuuuguuucccaugugcagucccaguugc

SEQ ID NO: 537209 - RNA, 19 nt, Human
uuccuuuuaagaaaaauga

SEQ ID NO: 537210 - RNA, 32 nt, Human
uuccuuuuagucuuuuucauccucuucucuuu

SEQ ID NO: 537211 - RNA, 32 nt, Human
uuccuuuuauaccucauucaucaugcuggauu

SEQ ID NO: 537212 - RNA, 29 nt, Human
uuccuuuucaauaaaaucagauuggaaca

SEQ ID NO: 537213 - RNA, 32 nt, Human
uuccuuuucauggaaccacccaccucccucuc

SEQ ID NO: 537214 - RNA, 32 nt, Human
uuccuuuuccaccacaggccccaaacugaucc

SEQ ID NO: 537215 - RNA, 32 nt, Human
uuccuuuuccccucaagaugucugagucagcu

SEQ ID NO: 537216 - RNA, 18 nt, Human
uuccuuuucccuuaaagg

SEQ ID NO: 537217 - RNA, 32 nt, Human
uuccuuuuccucauaccaacuugacuauguuu

SEQ ID NO: 537218 - RNA, 31 nt, Human
uuccuuuuccucuuggagguuggaguccccu

SEQ ID NO: 537219 - RNA, 32 nt, Human
uuccuuuucuccuuucuuuccuccuugaagcc

SEQ ID NO: 537220 - RNA, 32 nt, Human
uuccuuuugaagcucaacuguugccaggagau

SEQ ID NO: 537221 - RNA, 32 nt, Human
uuccuuuugagcccaucucagccagaaccagc

SEQ ID NO: 537222 - RNA, 32 nt, Human
uuccuuuugaggagcuggagggguggggagcu

SEQ ID NO: 537223 - RNA, 32 nt, Human
uuccuuuugccugguaaccaggaggaguggcu

SEQ ID NO: 537224 - RNA, 32 nt, Human
uuccuuuuguaaaccucugucucccaauuucu

SEQ ID NO: 537225 - RNA, 32 nt, Human
uuccuuuuguucuuccuuuacuucuccagcuu

SEQ ID NO: 537226 - RNA, 32 nt, Human
uuccuuuuuaaagcauagaaguaguauguggg

SEQ ID NO: 537227 - RNA, 32 nt, Human
uuccuuuuuagauugccaauuuugccaauuuu

SEQ ID NO: 537228 - RNA, 32 nt, Human
uuccuuuuucauuuucaagguuuacgcacugc

SEQ ID NO: 537229 - RNA, 32 nt, Human
uuccuuuuuccucuccucuccugccgagagug

SEQ ID NO: 537230 - RNA, 32 nt, Human
uuccuuuuuccuucccccuccuccacuccuac

SEQ ID NO: 537231 - RNA, 32 nt, Human
uuccuuuuucgaggauggaaagcuacugauug

SEQ ID NO: 537232 - RNA, 32 nt, Human
uuccuuuuugagacagggucuuacucuuguca

SEQ ID NO: 537233 - RNA, 32 nt, Human
uucgaaaccagccugaccaacguggagaaacc

SEQ ID NO: 537234 - RNA, 32 nt, Human
uucgaaaccagccuggccaaaacagugaaacc

SEQ ID NO: 537235 - RNA, 32 nt, Human
uucgaaaccagccuggccaacaaggugagacc

SEQ ID NO: 537236 - RNA, 24 nt, Human
uucgaaaccagccuggccaacaua

SEQ ID NO: 537237 - RNA, 32 nt, Human
uucgaaaccagccuggccaacauagugaaacc

SEQ ID NO: 537238 - RNA, 24 nt, Human
uucgaaaccagccuggccaacaug

SEQ ID NO: 537239 - RNA, 32 nt, Human
uucgaaaccagccuggccaacauggagaaacc

SEQ ID NO: 537240 - RNA, 32 nt, Human
uucgaaaccagccuggccaacauggugaaacc

SEQ ID NO: 537241 - RNA, 32 nt, Human
uucgaaaccagccuggccaacuugaugaaacc

SEQ ID NO: 537242 - RNA, 32 nt, Human
uucgaaaccagccugggcaacauagugagacc

SEQ ID NO: 537243 - RNA, 24 nt, Human
uucgaaaccagccugggcaacgug

SEQ ID NO: 537244 - RNA, 32 nt, Human
uucgaaaccagccugugcaacacagcgagacc

SEQ ID NO: 537245 - RNA, 32 nt, Human
uucgaaaccagccuucccaacauggugaaacc

SEQ ID NO: 537246 - RNA, 24 nt, Human
uucgaaaccagcuuggccaacaug

SEQ ID NO: 537247 - RNA, 32 nt, Human
uucgaaacuagccuggccaacaucaugaaacc

SEQ ID NO: 537248 - RNA, 32 nt, Human
uucgaaagauggggcgccauguuucagagaac

SEQ ID NO: 537249 - RNA, 24 nt, Human
uucgaaaucagccuaggcaacaua

SEQ ID NO: 537250 - RNA, 32 nt, Human
uucgaaaucagccuaggcaacauaguaagacc

SEQ ID NO: 537251 - RNA, 32 nt, Human
uucgaaccagccuggccaacauggugaaacug

SEQ ID NO: 537252 - RNA, 23 nt, Human
uucgaaccaguuugggcaacaug

SEQ ID NO: 537253 - RNA, 32 nt, Human
uucgaaccaguuugggcaacauggcgaaaccc

SEQ ID NO: 537254 - RNA, 32 nt, Human
uucgaacucuguaaucccagcacuuugggagg

SEQ ID NO: 537255 - RNA, 32 nt, Human
uucgaagacacaugauaaggcacacuggagac

SEQ ID NO: 537256 - RNA, 32 nt, Human
uucgaagaggaaaugggaucagagaagccgcu

SEQ ID NO: 537257 - RNA, 32 nt, Human
uucgaagccagccugggcaacaaagugagacc

SEQ ID NO: 537258 - RNA, 32 nt, Human
uucgaagcucacugugccucuuguuuccgagg

SEQ ID NO: 537259 - RNA, 32 nt, Human
uucgaaggaacacauuaaacugguggaugcag

SEQ ID NO: 537260 - RNA, 32 nt, Human
uucgaagucacaugauaacacacacaggagau

SEQ ID NO: 537261 - RNA, 32 nt, Human
uucgaagucagccuggccaacguggugaaacc

SEQ ID NO: 537262 - RNA, 32 nt, Human
uucgaaucacaaucauugccacugugguuugc

SEQ ID NO: 537263 - RNA, 32 nt, Human
uucgaauggaaauggcauuucaugaggccucc

SEQ ID NO: 537264 - RNA, 32 nt, Human
uucgaauguauaauacuuccacagcaacaggu

SEQ ID NO: 537265 - RNA, 32 nt, Human
uucgacaccaaccugagcaacauggcgaaacc

SEQ ID NO: 537266 - RNA, 32 nt, Human
uucgacaccagccuggccaacacagugaaaug

SEQ ID NO: 537267 - RNA, 24 nt, Human
uucgacaccagccuggccaacaug

SEQ ID NO: 537268 - RNA, 32 nt, Human
uucgacaccagccuggccaacauggugaaacc

SEQ ID NO: 537269 - RNA, 32 nt, Human
uucgacaccaggcggauccgcucugcagcacg

SEQ ID NO: 537270 - RNA, 24 nt, Human
uucgacaccaucuugggcaacaug

SEQ ID NO: 537271 - RNA, 32 nt, Human
uucgacaccaucuugggcaacauggugaaacc

SEQ ID NO: 537272 - RNA, 24 nt, Human
uucgacacuagccuggccaacaua

SEQ ID NO: 537273 - RNA, 32 nt, Human
uucgacacugugggugaggccugguuuuuguu

SEQ ID NO: 537274 - RNA, 32 nt, Human
uucgacagaacugccguauaccuuuacccuca

SEQ ID NO: 537275 - RNA, 32 nt, Human
uucgacagcagugacagaucagugcauuuccc

SEQ ID NO: 537276 - RNA, 32 nt, Human
uucgacagggucucacuguauugcccagguug

SEQ ID NO: 537277 - RNA, 32 nt, Human
uucgacauuucaccggcaacaccaagaggguu

SEQ ID NO: 537278 - RNA, 29 nt, Human
uucgaccagcuucuuugugccucuuuucu

SEQ ID NO: 537279 - RNA, 32 nt, Human
uucgaccagcuucuuugugccucuuuucucuc

SEQ ID NO: 537280 - RNA, 32 nt, Human
uucgaccuccacugcgccccaccucccugccu

SEQ ID NO: 537281 - RNA, 32 nt, Human
uucgaccucuguuauaggcagucuucucuuua

SEQ ID NO: 537282 - RNA, 32 nt, Human
uucgaccuuggacuucucagccuccagaauga

SEQ ID NO: 537283 - RNA, 32 nt, Human
uucgacucacugcaaccucugccucccagguu

SEQ ID NO: 537284 - RNA, 32 nt, Human
uucgacugaaaacacaaaugugcucuagugcu

SEQ ID NO: 537285 - RNA, 32 nt, Human
uucgacugcucuguugagaggguggagacaga

SEQ ID NO: 537286 - RNA, 32 nt, Human
uucgacuucauuuugccaccucugccccaauu

SEQ ID NO: 537287 - RNA, 32 nt, Human
uucgacuuuucagagcccuccugcucacuuga

SEQ ID NO: 537288 - RNA, 24 nt, Human
uucgagaaaagccugggcaacaug

SEQ ID NO: 537289 - RNA, 32 nt, Human
uucgagaaaagccugggcaacauggugaaacc

SEQ ID NO: 537290 - RNA, 24 nt, Human
uucgagaacagucuggccaacaug

SEQ ID NO: 537291 - RNA, 32 nt, Human
uucgagaacagucuggccaacauggcgaaacc

SEQ ID NO: 537292 - RNA, 24 nt, Human
uucgagaagagccugggcaacaua

SEQ ID NO: 537293 - RNA, 32 nt, Human
uucgagaagagccugggcaacauagugagacc

SEQ ID NO: 537294 - RNA, 32 nt, Human
uucgagaauacccuggccaacauggugaaacc

SEQ ID NO: 537295 - RNA, 24 nt, Human
uucgagacaaaccugggcaaugug

SEQ ID NO: 537296 - RNA, 22 nt, Human
uucgagacaagccuggguaaca

SEQ ID NO: 537297 - RNA, 32 nt, Human
uucgagacagacauuugggacugaccucucua

SEQ ID NO: 537298 - RNA, 23 nt, Human
uucgagacagccuggccaacaug

SEQ ID NO: 537299 - RNA, 32 nt, Human
uucgagaccaaccgaccaacauggugaaaccc

SEQ ID NO: 537300 - RNA, 32 nt, Human
uucgagaccaaccuagccaacauggugaaacc

SEQ ID NO: 537301 - RNA, 32 nt, Human
uucgagaccaaccuggccaaaguggugaaacc

SEQ ID NO: 537302 - RNA, 32 nt, Human
uucgagaccaaccugggcaacauagugagauu

SEQ ID NO: 537303 - RNA, 24 nt, Human
uucgagaccaacuugggcaacaug

SEQ ID NO: 537304 - RNA, 32 nt, Human
uucgagaccaacuugggcaacauggugaaaca

SEQ ID NO: 537305 - RNA, 32 nt, Human
uucgagaccacccuggccaacauggcaaaacc

SEQ ID NO: 537306 - RNA, 32 nt, Human
uucgagaccacccuggccaacauggugaaacc

SEQ ID NO: 537307 - RNA, 32 nt, Human
uucgagaccacccuggccaacguggugaaacc

SEQ ID NO: 537308 - RNA, 32 nt, Human
uucgagaccacccuggccaauauggugaaacc

SEQ ID NO: 537309 - RNA, 24 nt, Human
uucgagaccacccugggcaacaug

SEQ ID NO: 537310 - RNA, 32 nt, Human
uucgagaccacccugggcaacauggugaaacc

SEQ ID NO: 537311 - RNA, 32 nt, Human
uucgagaccagacuggccaacauggagaaacc

SEQ ID NO: 537312 - RNA, 32 nt, Human
uucgagaccagcaugaccaacauggugaaacc

SEQ ID NO: 537313 - RNA, 32 nt, Human
uucgagaccagccagaccaacaugaugaaacc

SEQ ID NO: 537314 - RNA, 32 nt, Human
uucgagaccagccaggccaacauggugaaaac

SEQ ID NO: 537315 - RNA, 32 nt, Human
uucgagaccagccaggccaacauggugaaacc

SEQ ID NO: 537316 - RNA, 24 nt, Human
uucgagaccagccagggcaacaug

SEQ ID NO: 537317 - RNA, 32 nt, Human
uucgagaccagccagggcaacauggugaaacc

SEQ ID NO: 537318 - RNA, 32 nt, Human
uucgagaccagcccagccaacauggcaaaacc

SEQ ID NO: 537319 - RNA, 32 nt, Human
uucgagaccagcccagccaacauggcgaaacc

SEQ ID NO: 537320 - RNA, 32 nt, Human
uucgagaccagcccagccaauuuagugaaacc

SEQ ID NO: 537321 - RNA, 32 nt, Human
uucgagaccagcccgcccaauauggugaaacc

SEQ ID NO: 537322 - RNA, 32 nt, Human
uucgagaccagcccggccaacauggugaaacc

SEQ ID NO: 537323 - RNA, 32 nt, Human
uucgagaccagccgggccaacauggugaaacc

SEQ ID NO: 537324 - RNA, 24 nt, Human
uucgagaccagccggggcaacaua

SEQ ID NO: 537325 - RNA, 32 nt, Human
uucgagaccagccggggcaacauggcaaaacc

SEQ ID NO: 537326 - RNA, 32 nt, Human
uucgagaccagccuaaacaacauagugaaacc

SEQ ID NO: 537327 - RNA, 32 nt, Human
uucgagaccagccuaaccaacauggagaaacc

SEQ ID NO: 537328 - RNA, 32 nt, Human
uucgagaccagccuaaccaacauggugaaacc

SEQ ID NO: 537329 - RNA, 32 nt, Human
uucgagaccagccuagccaacauggugaaacc

SEQ ID NO: 537330 - RNA, 32 nt, Human
uucgagaccagccuagccaacauggugaacua

SEQ ID NO: 537331 - RNA, 32 nt, Human
uucgagaccagccuagcuaacauggcaaaacc

SEQ ID NO: 537332 - RNA, 32 nt, Human
uucgagaccagccuagcuaacaugguaaaacu

SEQ ID NO: 537333 - RNA, 24 nt, Human
uucgagaccagccuaggcaacaug

SEQ ID NO: 537334 - RNA, 32 nt, Human
uucgagaccagccuaggcaacauggagaaacc

SEQ ID NO: 537335 - RNA, 24 nt, Human
uucgagaccagccuaggugacaua

SEQ ID NO: 537336 - RNA, 32 nt, Human
uucgagaccagccuaggugacauagugagacc

SEQ ID NO: 537337 - RNA, 32 nt, Human
uucgagaccagccucaacauggagaaaccccg

SEQ ID NO: 537338 - RNA, 32 nt, Human
uucgagaccagccucagcaacacagugaaacc

SEQ ID NO: 537339 - RNA, 32 nt, Human
uucgagaccagccucgccaacauggcgaaacc

SEQ ID NO: 537340 - RNA, 32 nt, Human
uucgagaccagccugaacaacacggugaaacc

SEQ ID NO: 537341 - RNA, 32 nt, Human
uucgagaccagccugaacaacauggcaaaacc

SEQ ID NO: 537342 - RNA, 32 nt, Human
uucgagaccagccugaccaacacggugaaacc

SEQ ID NO: 537343 - RNA, 32 nt, Human
uucgagaccagccugaccaacauagugaaacc

SEQ ID NO: 537344 - RNA, 32 nt, Human
uucgagaccagccugaccaacaugacgaaacc

SEQ ID NO: 537345 - RNA, 32 nt, Human
uucgagaccagccugaccaacaugaugaaaug

SEQ ID NO: 537346 - RNA, 32 nt, Human
uucgagaccagccugaccaacauggagaaacc

SEQ ID NO: 537347 - RNA, 32 nt, Human
uucgagaccagccugaccaacauggagaaacu

SEQ ID NO: 537348 - RNA, 32 nt, Human
uucgagaccagccugaccaacauggagaaaug

SEQ ID NO: 537349 - RNA, 32 nt, Human
uucgagaccagccugaccaacauggagaagcc

SEQ ID NO: 537350 - RNA, 32 nt, Human
uucgagaccagccugaccaacauggagauauc

SEQ ID NO: 537351 - RNA, 32 nt, Human
uucgagaccagccugaccaacauggcaaaacc

SEQ ID NO: 537352 - RNA, 32 nt, Human
uucgagaccagccugaccaacauggcgaaacc

SEQ ID NO: 537353 - RNA, 32 nt, Human
uucgagaccagccugaccaacaugguaaaacc

SEQ ID NO: 537354 - RNA, 32 nt, Human
uucgagaccagccugaccaacauggugaaaac

SEQ ID NO: 537355 - RNA, 32 nt, Human
uucgagaccagccugaccaacauggugaaaca

SEQ ID NO: 537356 - RNA, 32 nt, Human
uucgagaccagccugaccaacauggugaaacc

SEQ ID NO: 537357 - RNA, 32 nt, Human
uucgagaccagccugaccaacauggugaaacg

SEQ ID NO: 537358 - RNA, 32 nt, Human
uucgagaccagccugaccaacauggugaaagc

SEQ ID NO: 537359 - RNA, 32 nt, Human
uucgagaccagccugaccaacauggugaaauc

SEQ ID NO: 537360 - RNA, 32 nt, Human
uucgagaccagccugaccaacauggugagacc

SEQ ID NO: 537361 - RNA, 32 nt, Human
uucgagaccagccugaccaacauggugaggcc

SEQ ID NO: 537362 - RNA, 32 nt, Human
uucgagaccagccugaccaacaugucgaaauc

SEQ ID NO: 537363 - RNA, 32 nt, Human
uucgagaccagccugaccaacguggagaaaca

SEQ ID NO: 537364 - RNA, 32 nt, Human
uucgagaccagccugaccaacguggugaaacc

SEQ ID NO: 537365 - RNA, 32 nt, Human
uucgagaccagccugaccaagaugaugaaacg

SEQ ID NO: 537366 - RNA, 32 nt, Human
uucgagaccagccugaccaauauggugaaacc

SEQ ID NO: 537367 - RNA, 32 nt, Human
uucgagaccagccugaccaccauggagaaacc

SEQ ID NO: 537368 - RNA, 32 nt, Human
uucgagaccagccugaccagcaugguggaacc

SEQ ID NO: 537369 - RNA, 32 nt, Human
uucgagaccagccugagaaacauagugagccc

SEQ ID NO: 537370 - RNA, 32 nt, Human
uucgagaccagccugagcaacacugugagacc

SEQ ID NO: 537371 - RNA, 24 nt, Human
uucgagaccagccugagcaacaug

SEQ ID NO: 537372 - RNA, 32 nt, Human
uucgagaccagccugagcaacauggcgaaacc

SEQ ID NO: 537373 - RNA, 32 nt, Human
uucgagaccagccugagcaacauggugaaacc

SEQ ID NO: 537374 - RNA, 32 nt, Human
uucgagaccagccugaucggcauggugaaacc

SEQ ID NO: 537375 - RNA, 32 nt, Human
uucgagaccagccugccaacauggugaaaccc

SEQ ID NO: 537376 - RNA, 32 nt, Human
uucgagaccagccugcccaaaaaggugaaacc

SEQ ID NO: 537377 - RNA, 32 nt, Human
uucgagaccagccugcccaaauggugaaaccc

SEQ ID NO: 537378 - RNA, 32 nt, Human
uucgagaccagccugcccaacauggugaaacc

SEQ ID NO: 537379 - RNA, 32 nt, Human
uucgagaccagccugcccaauauggugaaacc

SEQ ID NO: 537380 - RNA, 32 nt, Human
uucgagaccagccugccuaacauggugaaacc

SEQ ID NO: 537381 - RNA, 24 nt, Human
uucgagaccagccuggacaacaua

SEQ ID NO: 537382 - RNA, 32 nt, Human
uucgagaccagccuggacaacauagugagacc

SEQ ID NO: 537383 - RNA, 32 nt, Human
uucgagaccagccuggacaacaucgugaaacc

SEQ ID NO: 537384 - RNA, 32 nt, Human
uucgagaccagccuggacaacauugugaaacc

SEQ ID NO: 537385 - RNA, 32 nt, Human
uucgagaccagccuggcaaacauggcgaaacc

SEQ ID NO: 537386 - RNA, 23 nt, Human
uucgagaccagccuggcaacaug

SEQ ID NO: 537387 - RNA, 32 nt, Human
uucgagaccagccuggcaacauggcaagaccc

SEQ ID NO: 537388 - RNA, 32 nt, Human
uucgagaccagccuggccaaaauagugaaacu

SEQ ID NO: 537389 - RNA, 32 nt, Human
uucgagaccagccuggccaacaaggcaaaacc

SEQ ID NO: 537390 - RNA, 32 nt, Human
uucgagaccagccuggccaacaaggugaaacc

SEQ ID NO: 537391 - RNA, 32 nt, Human
uucgagaccagccuggccaacacggugaaaac

SEQ ID NO: 537392 - RNA, 32 nt, Human
uucgagaccagccuggccaacacggugaaacc

SEQ ID NO: 537393 - RNA, 32 nt, Human
uucgagaccagccuggccaacacggugagacc

SEQ ID NO: 537394 - RNA, 32 nt, Human
uucgagaccagccuggccaacacuggucucug

SEQ ID NO: 537395 - RNA, 24 nt, Human
uucgagaccagccuggccaacaua

SEQ ID NO: 537396 - RNA, 32 nt, Human
uucgagaccagccuggccaacauaaugaaacc

SEQ ID NO: 537397 - RNA, 32 nt, Human
uucgagaccagccuggccaacauagcaaaacc

SEQ ID NO: 537398 - RNA, 32 nt, Human
uucgagaccagccuggccaacauagcgagagc

SEQ ID NO: 537399 - RNA, 32 nt, Human
uucgagaccagccuggccaacauagugaaacc

SEQ ID NO: 537400 - RNA, 24 nt, Human
uucgagaccagccuggccaacaug

SEQ ID NO: 537401 - RNA, 32 nt, Human
uucgagaccagccuggccaacaugacgaaacc

SEQ ID NO: 537402 - RNA, 32 nt, Human
uucgagaccagccuggccaacaugaugaaacc

SEQ ID NO: 537403 - RNA, 32 nt, Human
uucgagaccagccuggccaacaugccuccagg

SEQ ID NO: 537404 - RNA, 32 nt, Human
uucgagaccagccuggccaacauggcaaaacc

SEQ ID NO: 537405 - RNA, 32 nt, Human
uucgagaccagccuggccaacauggcaaaauc

SEQ ID NO: 537406 - RNA, 32 nt, Human
uucgagaccagccuggccaacauggcaagacc

SEQ ID NO: 537407 - RNA, 32 nt, Human
uucgagaccagccuggccaacauggcgaaaac

SEQ ID NO: 537408 - RNA, 32 nt, Human
uucgagaccagccuggccaacauggcgaaaca

SEQ ID NO: 537409 - RNA, 32 nt, Human
uucgagaccagccuggccaacauggcgaaacc

SEQ ID NO: 537410 - RNA, 32 nt, Human
uucgagaccagccuggccaacauggcgaaacu

SEQ ID NO: 537411 - RNA, 32 nt, Human
uucgagaccagccuggccaacauggcgaaauc

SEQ ID NO: 537412 - RNA, 32 nt, Human
uucgagaccagccuggccaacauggcggaacc

SEQ ID NO: 537413 - RNA, 32 nt, Human
uucgagaccagccuggccaacaugguaaaacc

SEQ ID NO: 537414 - RNA, 32 nt, Human
uucgagaccagccuggccaacaugguaaaacu

SEQ ID NO: 537415 - RNA, 32 nt, Human
uucgagaccagccuggccaacaugguaaacgc

SEQ ID NO: 537416 - RNA, 32 nt, Human
uucgagaccagccuggccaacauggucaaaac

SEQ ID NO: 537417 - RNA, 32 nt, Human
uucgagaccagccuggccaacauggugaaaac

SEQ ID NO: 537418 - RNA, 31 nt, Human
uucgagaccagccuggccaacauggugaaac

SEQ ID NO: 537419 - RNA, 32 nt, Human
uucgagaccagccuggccaacauggugaaacc

SEQ ID NO: 537420 - RNA, 32 nt, Human
uucgagaccagccuggccaacauggugaaacg

SEQ ID NO: 537421 - RNA, 32 nt, Human
uucgagaccagccuggccaacauggugaaacu

SEQ ID NO: 537422 - RNA, 32 nt, Human
uucgagaccagccuggccaacauggugaaccc

SEQ ID NO: 537423 - RNA, 32 nt, Human
uucgagaccagccuggccaacauggugaagcc

SEQ ID NO: 537424 - RNA, 32 nt, Human
uucgagaccagccuggccaacauggugauacc

SEQ ID NO: 537425 - RNA, 32 nt, Human
uucgagaccagccuggccaacauggugugaga

SEQ ID NO: 537426 - RNA, 32 nt, Human
uucgagaccagccuggccaacaugguuaaacc

SEQ ID NO: 537427 - RNA, 32 nt, Human
uucgagaccagccuggccaacaugucgaacuc

SEQ ID NO: 537428 - RNA, 32 nt, Human
uucgagaccagccuggccaaccaacaugguga

SEQ ID NO: 537429 - RNA, 32 nt, Human
uucgagaccagccuggccaacccagccugguc

SEQ ID NO: 537430 - RNA, 24 nt, Human
uucgagaccagccuggccaacgug

SEQ ID NO: 537431 - RNA, 32 nt, Human
uucgagaccagccuggccaacguggugaaacc

SEQ ID NO: 537432 - RNA, 32 nt, Human
uucgagaccagccuggccaacguggugaaacg

SEQ ID NO: 537433 - RNA, 32 nt, Human
uucgagaccagccuggccaacugccugaaacc

SEQ ID NO: 537434 - RNA, 32 nt, Human
uucgagaccagccuggccaacuuggugaaacc

SEQ ID NO: 537435 - RNA, 32 nt, Human
uucgagaccagccuggccaagagaccagccug

SEQ ID NO: 537436 - RNA, 32 nt, Human
uucgagaccagccuggccaagauggcgaaacg

SEQ ID NO: 537437 - RNA, 32 nt, Human
uucgagaccagccuggccaauaaggugaaacc

SEQ ID NO: 537438 - RNA, 32 nt, Human
uucgagaccagccuggccaauaaggugaaacu

SEQ ID NO: 537439 - RNA, 32 nt, Human
uucgagaccagccuggccaauacggcaaaacc

SEQ ID NO: 537440 - RNA, 24 nt, Human
uucgagaccagccuggccaauaug

SEQ ID NO: 537441 - RNA, 32 nt, Human
uucgagaccagccuggccaauaugcaauaugg

SEQ ID NO: 537442 - RNA, 32 nt, Human
uucgagaccagccuggccaauauggugaaacc

SEQ ID NO: 537443 - RNA, 24 nt, Human
uucgagaccagccuggccaaugug

SEQ ID NO: 537444 - RNA, 32 nt, Human
uucgagaccagccuggccaauguggugaaacc

SEQ ID NO: 537445 - RNA, 32 nt, Human
uucgagaccagccuggccacauggcaaaaccc

SEQ ID NO: 537446 - RNA, 32 nt, Human
uucgagaccagccuggccacauggugaaaccc

SEQ ID NO: 537447 - RNA, 32 nt, Human
uucgagaccagccuggccagcaaggugaaacc

SEQ ID NO: 537448 - RNA, 24 nt, Human
uucgagaccagccuggccagcaug

SEQ ID NO: 537449 - RNA, 32 nt, Human
uucgagaccagccuggccagcauggcaaaacc

SEQ ID NO: 537450 - RNA, 32 nt, Human
uucgagaccagccuggccagcauggcgaaacc

SEQ ID NO: 537451 - RNA, 32 nt, Human
uucgagaccagccuggccagcauggugaaacc

SEQ ID NO: 537452 - RNA, 32 nt, Human
uucgagaccagccuggccagcauggugaaacu

SEQ ID NO: 537453 - RNA, 32 nt, Human
uucgagaccagccuggccagcauggugagacc

SEQ ID NO: 537454 - RNA, 32 nt, Human
uucgagaccagccuggccagcgguuccaguga

SEQ ID NO: 537455 - RNA, 32 nt, Human
uucgagaccagccuggccauuauggugaaacc

SEQ ID NO: 537456 - RNA, 32 nt, Human
uucgagaccagccuggcccacauggugaaacc

SEQ ID NO: 537457 - RNA, 24 nt, Human
uucgagaccagccuggcuaacaug

SEQ ID NO: 537458 - RNA, 32 nt, Human
uucgagaccagccuggcuaacauggcaaaacc

SEQ ID NO: 537459 - RNA, 32 nt, Human
uucgagaccagccuggcuaacauggugaaacc

SEQ ID NO: 537460 - RNA, 32 nt, Human
uucgagaccagccuggcuggcuagcaugguga

SEQ ID NO: 537461 - RNA, 24 nt, Human
uucgagaccagccugggaagcaug

SEQ ID NO: 537462 - RNA, 32 nt, Human
uucgagaccagccugggagacagagcauggaa

SEQ ID NO: 537463 - RNA, 21 nt, Human
uucgagaccagccugggcaac

SEQ ID NO: 537464 - RNA, 22 nt, Human
uucgagaccagccugggcaaca

SEQ ID NO: 537465 - RNA, 32 nt, Human
uucgagaccagccugggcaacaaagugagacu

SEQ ID NO: 537466 - RNA, 32 nt, Human
uucgagaccagccugggcaacacagaggaccc

SEQ ID NO: 537467 - RNA, 32 nt, Human
uucgagaccagccugggcaacacagcgagaac

SEQ ID NO: 537468 - RNA, 32 nt, Human
uucgagaccagccugggcaacacagcgagauc

SEQ ID NO: 537469 - RNA, 32 nt, Human
uucgagaccagccugggcaacagcaagaccuc

SEQ ID NO: 537470 - RNA, 24 nt, Human
uucgagaccagccugggcaacaua

SEQ ID NO: 537471 - RNA, 32 nt, Human
uucgagaccagccugggcaacauagagagacc

SEQ ID NO: 537472 - RNA, 32 nt, Human
uucgagaccagccugggcaacauagcaagacc

SEQ ID NO: 537473 - RNA, 32 nt, Human
uucgagaccagccugggcaacauagugagacc

SEQ ID NO: 537474 - RNA, 32 nt, Human
uucgagaccagccugggcaacauagugagacu

SEQ ID NO: 537475 - RNA, 32 nt, Human
uucgagaccagccugggcaacauaugagaaac

SEQ ID NO: 537476 - RNA, 32 nt, Human
uucgagaccagccugggcaacauaugggacac

SEQ ID NO: 537477 - RNA, 32 nt, Human
uucgagaccagccugggcaacaucgggagacc

SEQ ID NO: 537478 - RNA, 24 nt, Human
uucgagaccagccugggcaacaug

SEQ ID NO: 537479 - RNA, 32 nt, Human
uucgagaccagccugggcaacauggagagacc

SEQ ID NO: 537480 - RNA, 32 nt, Human
uucgagaccagccugggcaacauggcgagacc

SEQ ID NO: 537481 - RNA, 32 nt, Human
uucgagaccagccugggcaacauggugaaacc

SEQ ID NO: 537482 - RNA, 32 nt, Human
uucgagaccagccugggcaacauggugaaauc

SEQ ID NO: 537483 - RNA, 32 nt, Human
uucgagaccagccugggcaacauggugagacc

SEQ ID NO: 537484 - RNA, 32 nt, Human
uucgagaccagccugggcaaccuaaugagagu

SEQ ID NO: 537485 - RNA, 22 nt, Human
uucgagaccagccugggcaacg

SEQ ID NO: 537486 - RNA, 32 nt, Human
uucgagaccagccugggcaacgcagugagaga

SEQ ID NO: 537487 - RNA, 24 nt, Human
uucgagaccagccugggcaacgug

SEQ ID NO: 537488 - RNA, 32 nt, Human
uucgagaccagccugggcaacguggcgaaauc

SEQ ID NO: 537489 - RNA, 32 nt, Human
uucgagaccagccugggcaacguggugaaacc

SEQ ID NO: 537490 - RNA, 24 nt, Human
uucgagaccagccugggcaagaug

SEQ ID NO: 537491 - RNA, 32 nt, Human
uucgagaccagccugggcaagauggcaagacc

SEQ ID NO: 537492 - RNA, 32 nt, Human
uucgagaccagccugggcaagauggugaaacc

SEQ ID NO: 537493 - RNA, 24 nt, Human
uucgagaccagccugggcagcaua

SEQ ID NO: 537494 - RNA, 32 nt, Human
uucgagaccagccugggcagcauagcaagacc

SEQ ID NO: 537495 - RNA, 32 nt, Human
uucgagaccagccugggcagcauagcaagauc

SEQ ID NO: 537496 - RNA, 32 nt, Human
uucgagaccagccugggcaucguagugagacu

SEQ ID NO: 537497 - RNA, 32 nt, Human
uucgagaccagccugggccacaugacaaagcc

SEQ ID NO: 537498 - RNA, 22 nt, Human
uucgagaccagccugggcgaca

SEQ ID NO: 537499 - RNA, 32 nt, Human
uucgagaccagccugggcgacacggugaaacc

SEQ ID NO: 537500 - RNA, 24 nt, Human
uucgagaccagccugggcuacaua

SEQ ID NO: 537501 - RNA, 32 nt, Human
uucgagaccagccugggcuacauagugagacc

SEQ ID NO: 537502 - RNA, 22 nt, Human
uucgagaccagccuggguaaca

SEQ ID NO: 537503 - RNA, 32 nt, Human
uucgagaccagccuggguaacauagcuagacc

SEQ ID NO: 537504 - RNA, 23 nt, Human
uucgagaccagccugguaacaug

SEQ ID NO: 537505 - RNA, 24 nt, Human
uucgagaccagccuggucaacaug

SEQ ID NO: 537506 - RNA, 32 nt, Human
uucgagaccagccuggucaacauggcaaaaca

SEQ ID NO: 537507 - RNA, 32 nt, Human
uucgagaccagccuggucaacauggcgaaauc

SEQ ID NO: 537508 - RNA, 32 nt, Human
uucgagaccagccuggucaacauggugaaacc

SEQ ID NO: 537509 - RNA, 32 nt, Human
uucgagaccagccuggucaacuuggugaaaac

SEQ ID NO: 537510 - RNA, 32 nt, Human
uucgagaccagccuggucaagauggugaaacc

SEQ ID NO: 537511 - RNA, 32 nt, Human
uucuuagguuuggaacagucuggucuccugug

SEQ ID NO: 537512 - RNA, 32 nt, Human
uucuuaguaucaagauucucagauucucuuug

SEQ ID NO: 537513 - RNA, 32 nt, Human
uucuuaguaugauuguacaguaaugaaugaaa

SEQ ID NO: 537514 - RNA, 32 nt, Human
uucuuagucccagcuucugcccagggaggcuu

SEQ ID NO: 537515 - RNA, 32 nt, Human
uucuuagugugguuuauugacaaucauuuaca

SEQ ID NO: 537516 - RNA, 32 nt, Human
uucuuaguguuugacacuccauauuucuuuuu

SEQ ID NO: 537517 - RNA, 32 nt, Human
uucuuauaauaugaaugcugauauuuaaaggu

SEQ ID NO: 537518 - RNA, 32 nt, Human
uucuuauagaauaaccugggcccaagugauuu

SEQ ID NO: 537519 - RNA, 32 nt, Human
uucuuauaguaagcggcgggcucgccagccuc

SEQ ID NO: 537520 - RNA, 32 nt, Human
uucuuauaguugcugacauuaauugcaagaaa

SEQ ID NO: 537521 - RNA, 32 nt, Human
uucuuaucaauauuuucuauaucacaaaaaug

SEQ ID NO: 537522 - RNA, 32 nt, Human
uucuuaucagaauaucuggcuggcccuguaau

SEQ ID NO: 537523 - RNA, 32 nt, Human
uucuuaucagucugacaaucucugccuuuuga

SEQ ID NO: 537524 - RNA, 32 nt, Human
uucuuaucuccagcucacaccuuuaagucuua

SEQ ID NO: 537525 - RNA, 32 nt, Human
uucuuaugaaagugcuugagcuuuuaaccagg

SEQ ID NO: 537526 - RNA, 21 nt, Human
uucuuauguuaucaccuucca

SEQ ID NO: 537527 - RNA, 32 nt, Human
uucuuauuaagccuguggaauugugagucaau

SEQ ID NO: 537528 - RNA, 32 nt, Human
uucuuauuacuggguggacugauaauauuuaa

SEQ ID NO: 537529 - RNA, 32 nt, Human
uucuuauuaggggaauuuuaagagcacaaaaa

SEQ ID NO: 537530 - RNA, 32 nt, Human
uucuuauuauucacugcacuauauucuaagca

SEQ ID NO: 537531 - RNA, 32 nt, Human
uucuuauucaccugaagaauuuugccacucgu

SEQ ID NO: 537532 - RNA, 32 nt, Human
uucuuauucagacuggccuuaaaacaagcucu

SEQ ID NO: 537533 - RNA, 32 nt, Human
uucuuauucauucuaggcaugacuccuauaua

SEQ ID NO: 537534 - RNA, 32 nt, Human
uucuuauuccacccuuucuggugucuauagga

SEQ ID NO: 537535 - RNA, 32 nt, Human
uucuuauucuaacuguggaugccaccggcuuc

SEQ ID NO: 537536 - RNA, 32 nt, Human
uucuuauucucccacaucccuacccacguuug

SEQ ID NO: 537537 - RNA, 32 nt, Human
uucuuauugcagugccuggugcuaggaagugc

SEQ ID NO: 537538 - RNA, 32 nt, Human
uucuuauugcccaggcuugagugcaaugaccu

SEQ ID NO: 537539 - RNA, 32 nt, Human
uucuuauuuacccuuuucucccuucccauuuc

SEQ ID NO: 537540 - RNA, 32 nt, Human
uucuuauuuuuaguaucccugugaauuacugu

SEQ ID NO: 537541 - RNA, 32 nt, Human
uucuucaaagcaagcaggagaaucucuaaaug

SEQ ID NO: 537542 - RNA, 32 nt, Human
uucuucaaagccccagcccuuuuggagguuac

SEQ ID NO: 537543 - RNA, 32 nt, Human
uucuucaaagcccccuccuccaugagagggga

SEQ ID NO: 537544 - RNA, 32 nt, Human
uucuucaaaggauuuaacauuuuaagugggag

SEQ ID NO: 537545 - RNA, 32 nt, Human
uucuucaaaggauuuuuauaggcuguggguuu

SEQ ID NO: 537546 - RNA, 21 nt, Human
uucuucaaagggaagcaacuu

SEQ ID NO: 537547 - RNA, 32 nt, Human
uucuucaacaaacuuacuuuuguuaaauuaaa

SEQ ID NO: 537548 - RNA, 32 nt, Human
uucuucaacaugcucaucaaguaccaguccuc

SEQ ID NO: 537549 - RNA, 32 nt, Human
uucuucaaccagugaucccccaccucggucac

SEQ ID NO: 537550 - RNA, 32 nt, Human
uucuucaacugcuugcuuuucccaggcuugcc

SEQ ID NO: 537551 - RNA, 32 nt, Human
uucuucaagaccuucacugcucugccucagug

SEQ ID NO: 537552 - RNA, 32 nt, Human
uucuucaagcugucugugucuuugugugucug

SEQ ID NO: 537553 - RNA, 32 nt, Human
uucuucaauaaauauuaucuuaauaucaguaa

SEQ ID NO: 537554 - RNA, 19 nt, Human
uucuucaaugcugcugcug

SEQ ID NO: 537555 - RNA, 32 nt, Human
uucuucacacuaugccucuuacuucauggaga

SEQ ID NO: 537556 - RNA, 32 nt, Human
uucuucacaggcacuccuggagauaugaagga

SEQ ID NO: 537557 - RNA, 32 nt, Human
uucuucaccagauuuaaauaaaaggaggaauu

SEQ ID NO: 537558 - RNA, 32 nt, Human
uucuucacccgucccuaccaggccaacucggc

SEQ ID NO: 537559 - RNA, 19 nt, Human
uucuucacuccugcugcug

SEQ ID NO: 537560 - RNA, 32 nt, Human
uucuucacugccuuuucucggugugguauuug

SEQ ID NO: 537561 - RNA, 32 nt, Human
uucuucacuggaauggcuucagcauggaaucu

SEQ ID NO: 537562 - RNA, 32 nt, Human
uucuucagagaguucauggcccagggagggaa

SEQ ID NO: 537563 - RNA, 24 nt, Human
uucuucagaugauggggagcacuu

SEQ ID NO: 537564 - RNA, 32 nt, Human
uucuucagcaggaagggugggaagggauaauu

SEQ ID NO: 537565 - RNA, 22 nt, Human
uucuucagccaagagggcacuu

SEQ ID NO: 537566 - RNA, 32 nt, Human
uucuucagccaagagggcacuuguuaauauga

SEQ ID NO: 537567 - RNA, 32 nt, Human
uucuucagccccacccccuccccacuagcucg

SEQ ID NO: 537568 - RNA, 32 nt, Human
uucuucagccuccaucccuggccuccuccccu

SEQ ID NO: 537569 - RNA, 32 nt, Human
uucuucagccucccgaguagcugagauuauag

SEQ ID NO: 537570 - RNA, 32 nt, Human
uucuucagccuccucugacuuuucuuuugggg

SEQ ID NO: 537571 - RNA, 32 nt, Human
uucuucagccuucuucagccuucuucagcccu

SEQ ID NO: 537572 - RNA, 32 nt, Human
uucuucagcugcugggggagugccagacagga

SEQ ID NO: 537573 - RNA, 32 nt, Human
uucuucagcugugccaucugcugcccaccaag

SEQ ID NO: 537574 - RNA, 32 nt, Human
uucuucaggaaggaagagaccugggcacccaa

SEQ ID NO: 537575 - RNA, 22 nt, Human
uucuucaggaccugacuggaca

SEQ ID NO: 537576 - RNA, 32 nt, Human
uucuucaggacucaggcuucuccaucauucuc

SEQ ID NO: 537577 - RNA, 32 nt, Human
uucuucaggcagccggugcacaguggacuuuu

SEQ ID NO: 537578 - RNA, 32 nt, Human
uucuucaggcccucccaaauugcccuugcccu

SEQ ID NO: 537579 - RNA, 22 nt, Human
uucuucaggcugaggaggacuu

SEQ ID NO: 537580 - RNA, 32 nt, Human
uucuucaggcugaggaggacuugcucaggccg

SEQ ID NO: 537581 - RNA, 32 nt, Human
uucuucagggaagaguagggacgccguuccag

SEQ ID NO: 537582 - RNA, 32 nt, Human
uucuucagguacugucucgguaucauucugcu

SEQ ID NO: 537583 - RNA, 32 nt, Human
uucuucagguuugagagaagauaaaaacauuu

SEQ ID NO: 537584 - RNA, 22 nt, Human
uucuucagucucuggggagcac

SEQ ID NO: 537585 - RNA, 32 nt, Human
uucuucagugaugucuccauccuugaucuuca

SEQ ID NO: 537586 - RNA, 32 nt, Human
uucuucaguggacaugaccccacccagccccc

SEQ ID NO: 537587 - RNA, 32 nt, Human
uucuucaguuuucuuuucuugcacugaucuuu

SEQ ID NO: 537588 - RNA, 32 nt, Human
uucuucauauuccugcuguuggaagcaguuga

SEQ ID NO: 537589 - RNA, 32 nt, Human
uucuucaucugucaaaugagaguaaucaugcc

SEQ ID NO: 537590 - RNA, 32 nt, Human
uucuucaugaacauaacucugcugaauguaaa

SEQ ID NO: 537591 - RNA, 32 nt, Human
uucuucauggaauugaaggccccuaugugcug

SEQ ID NO: 537592 - RNA, 32 nt, Human
uucuucauggauauucuuggucucacauacuu

SEQ ID NO: 537593 - RNA, 32 nt, Human
uucuucauucuagaaauuuauuuuggauaaau

SEQ ID NO: 537594 - RNA, 32 nt, Human
uucuucauuucugcuuucugcccugucaguuu

SEQ ID NO: 537595 - RNA, 32 nt, Human
uucuucauuuucuucuugauucagggcuucuu

SEQ ID NO: 537596 - RNA, 32 nt, Human
uucuuccacagcaaaugagauguaugcccaaa

SEQ ID NO: 537597 - RNA, 32 nt, Human
uucuuccacaguucagcaaacaacugcuagcu

SEQ ID NO: 537598 - RNA, 32 nt, Human
uucuuccacccacaaacuccaggcuggaagua

SEQ ID NO: 537599 - RNA, 32 nt, Human
uucuuccaccuccuccucuuccucagacaacc

SEQ ID NO: 537600 - RNA, 32 nt, Human
uucuuccaccugcuugauugugccaguguuug

SEQ ID NO: 537601 - RNA, 32 nt, Human
uucuuccacuggcuccacauccaccccacugg

SEQ ID NO: 537602 - RNA, 32 nt, Human
uucuuccagaagcacgggcacaggagcauguu

SEQ ID NO: 537603 - RNA, 32 nt, Human
uucuuccagcacucuggccuccuugcuguucu

SEQ ID NO: 537604 - RNA, 32 nt, Human
uucuuccagccaagccucuccacuccuuccac

SEQ ID NO: 537605 - RNA, 32 nt, Human
uucuuccagcgauggucucccacucagagcug

SEQ ID NO: 537606 - RNA, 32 nt, Human
uucuuccaucagcucugcaccaaaaagcuuuu

SEQ ID NO: 537607 - RNA, 32 nt, Human
uucuuccaugauuuuaagggcuuucuuuuuaa

SEQ ID NO: 537608 - RNA, 32 nt, Human
uucuuccaugucuuugaccacaggguuguugc

SEQ ID NO: 537609 - RNA, 32 nt, Human
uucuucccacucuggggguuucuaucacugug

SEQ ID NO: 537610 - RNA, 32 nt, Human
uucuucccagcacccagagaauccuuccucag

SEQ ID NO: 537611 - RNA, 32 nt, Human
uucuucccaguaaccacuauucuauuuugucu

SEQ ID NO: 537612 - RNA, 32 nt, Human
uucuucccauagcuuccagccugguggggaau

SEQ ID NO: 537613 - RNA, 32 nt, Human
uucuucccaucuggccagccuugugugaaaau

SEQ ID NO: 537614 - RNA, 32 nt, Human
uucuucccauuuccuggcacacucugccccuc

SEQ ID NO: 537615 - RNA, 32 nt, Human
uucuuccccacagcaggcugcucagagggggu

SEQ ID NO: 537616 - RNA, 32 nt, Human
uucuuccccauucuucccagcagcccaaagcu

SEQ ID NO: 537617 - RNA, 32 nt, Human
uucuucccccuucacgugaacugccuccauga

SEQ ID NO: 537618 - RNA, 32 nt, Human
uucuuccccgagggugcauguugcaggaggga

SEQ ID NO: 537619 - RNA, 32 nt, Human
uucuuccccucaccccugcuuauuaacacaau

SEQ ID NO: 537620 - RNA, 32 nt, Human
uucuuccccucacuacccagaucucugccugc

SEQ ID NO: 537621 - RNA, 32 nt, Human
uucuuccccuuguguuuccagucaccuaacuu

SEQ ID NO: 537622 - RNA, 32 nt, Human
uucuucccuccacccucacuccaaccacccca

SEQ ID NO: 537623 - RNA, 32 nt, Human
uucuucccuccccugcuugucuauuuucuucu

SEQ ID NO: 537624 - RNA, 32 nt, Human
uucuucccuccuccccugucucuggcugucuc

SEQ ID NO: 537625 - RNA, 32 nt, Human
uucuucccucugagagugggggaggacggcgg

SEQ ID NO: 537626 - RNA, 32 nt, Human
uucuucccucuguuauucauucaucaagcagg

SEQ ID NO: 537627 - RNA, 32 nt, Human
uucuucccugcucuguccccuaagcucccucc

SEQ ID NO: 537628 - RNA, 32 nt, Human
uucuucccugugugauuuuugccaucaaaaua

SEQ ID NO: 537629 - RNA, 32 nt, Human
uucuucccuuccccuucuccccacaccugcac

SEQ ID NO: 537630 - RNA, 32 nt, Human
uucuucccuucccuucccuucccuuuccuuuu

SEQ ID NO: 537631 - RNA, 32 nt, Human
uucuucccuuccuuuuucccugccucccuuuu

SEQ ID NO: 537632 - RNA, 32 nt, Human
uucuucccuuuccucugcuguuuccuucuugu

SEQ ID NO: 537633 - RNA, 32 nt, Human
uucuucccuuuuccuuucuauucucuuucaag

SEQ ID NO: 537634 - RNA, 32 nt, Human
uucuuccgccuauuaaacuuuccgcuucuuaa

SEQ ID NO: 537635 - RNA, 32 nt, Human
uucuuccuaccuucuuccuuuuugacuaaaua

SEQ ID NO: 537636 - RNA, 32 nt, Human
uucuuccucacugcacccccagcccugcaccc

SEQ ID NO: 537637 - RNA, 32 nt, Human
uucuuccucagggcucuuguucucccagaagc

SEQ ID NO: 537638 - RNA, 32 nt, Human
uucuuccucauuuuucucuugcugcagccaug

SEQ ID NO: 537639 - RNA, 32 nt, Human
uucuuccuccaacucuauccuuuucuuaugac

SEQ ID NO: 537640 - RNA, 32 nt, Human
uucuuccucccaggcccaguggguggaaucug

SEQ ID NO: 537641 - RNA, 32 nt, Human
uucuuccucccuuucuccuucuccccuccuuc

SEQ ID NO: 537642 - RNA, 32 nt, Human
uucuuccuccuucguuucuuccuuuccuccuc

SEQ ID NO: 537643 - RNA, 32 nt, Human
uucuuccucuacccuuccgaaggauccaguau

SEQ ID NO: 537644 - RNA, 19 nt, Human
uucuuccucuuaucuaccu

SEQ ID NO: 537645 - RNA, 32 nt, Human
uucuuccucuucguucuucaccuggguuuccu

SEQ ID NO: 537646 - RNA, 32 nt, Human
uucuuccucuucuccuugggccaguuaauaau

SEQ ID NO: 537647 - RNA, 19 nt, Human
uucuuccugcaauacagug

SEQ ID NO: 537648 - RNA, 32 nt, Human
uucuuccugccacccuuugggcucagaggagg

SEQ ID NO: 537649 - RNA, 32 nt, Human
uucuuccugccaugcagaacuggacuugaguu

SEQ ID NO: 537650 - RNA, 32 nt, Human
uucuuccugccugcuugucuguuccuauauua

SEQ ID NO: 537651 - RNA, 32 nt, Human
uucuuccugccuggcuugucuguuccuauauu

SEQ ID NO: 537652 - RNA, 32 nt, Human
uucuuccugggcagguccuggagcggcuguuc

SEQ ID NO: 537653 - RNA, 32 nt, Human
uucuuccugucauaaccagcugccuuaguaga

SEQ ID NO: 537654 - RNA, 32 nt, Human
uucuuccugucugaucugaaugccuuuuauuu

SEQ ID NO: 537655 - RNA, 32 nt, Human
uucuuccuguucugggaaucaauguaacagcc

SEQ ID NO: 537656 - RNA, 32 nt, Human
uucuuccuguucugugcuguguauagugccac

SEQ ID NO: 537657 - RNA, 32 nt, Human
uucuuccuuccaggaugguguauggugaggca

SEQ ID NO: 537658 - RNA, 32 nt, Human
uucuuccuucuuucucuucccuccuucccuuc

SEQ ID NO: 537659 - RNA, 32 nt, Human
uucuuccuucuuucuuccuuuuucucucuccu

SEQ ID NO: 537660 - RNA, 32 nt, Human
uucuuccuuguccuaccccaggggccgggcca

SEQ ID NO: 537661 - RNA, 32 nt, Human
uucuuccuuuccaaccccuuccuuccuuuucc

SEQ ID NO: 537662 - RNA, 32 nt, Human
uucuuccuuucccauucaccuggcucaauccu

SEQ ID NO: 537663 - RNA, 32 nt, Human
uucuuccuuuuaccuagaaugccucauuuaaa

SEQ ID NO: 537664 - RNA, 32 nt, Human
uucuucgacuacauacugcagcagaaccagca

SEQ ID NO: 537665 - RNA, 32 nt, Human
uucuucgagacagggucucacucugucaccca

SEQ ID NO: 537666 - RNA, 32 nt, Human
uucuucgcucaguaugaagaaaagcaacccaa

SEQ ID NO: 537667 - RNA, 32 nt, Human
uucuucgcuuccaccuuuuucucccccacacu

SEQ ID NO: 537668 - RNA, 32 nt, Human
uucuucggcagugcuggauaaagugggaugau

SEQ ID NO: 537669 - RNA, 32 nt, Human
uucuucggugacacuggcauugcuggguggug

SEQ ID NO: 537670 - RNA, 32 nt, Human
uucuucggugacacuggcguugcuggguggca

SEQ ID NO: 537671 - RNA, 32 nt, Human
uucuucggugacacuggcguugcuggguggcg

SEQ ID NO: 537672 - RNA, 32 nt, Human
uucuucuaacugacuucugcuuuccacggcgu

SEQ ID NO: 537673 - RNA, 31 nt, Human
uucuucuaagcgacuucgaugccaaggaagu

SEQ ID NO: 537674 - RNA, 32 nt, Human
uucuucuacauccuccccauuucuguacugaa

SEQ ID NO: 537675 - RNA, 32 nt, Human
uucuucuacugcccuuaacucugguauacacc

SEQ ID NO: 537676 - RNA, 32 nt, Human
uucuucuacuuuccccagcucuucccaccuug

SEQ ID NO: 537677 - RNA, 20 nt, Human
uucuucuagagaaaaaggga

SEQ ID NO: 537678 - RNA, 32 nt, Human
uucuucuagcagucugugccuccucucugacc

SEQ ID NO: 537679 - RNA, 32 nt, Human
uucuucuauaaauguuuuucccugcacaacaa

SEQ ID NO: 537680 - RNA, 32 nt, Human
uucuucuaucuccccucuauacuuccucugca

SEQ ID NO: 537681 - RNA, 32 nt, Human
uucuucuauuuagaaggugaccuccugacagc

SEQ ID NO: 537682 - RNA, 32 nt, Human
uucuucuauuuuuaguagagacaggguuucac

SEQ ID NO: 537683 - RNA, 32 nt, Human
uucuucucaccuuguucucugccuccagagga

SEQ ID NO: 537684 - RNA, 32 nt, Human
uucuucuccauugggaaugaaggugucaggcg

SEQ ID NO: 537685 - RNA, 32 nt, Human
uucuucucccccagugcugaucuugcugggcc

SEQ ID NO: 537686 - RNA, 32 nt, Human
uucuucucccuguguccauguguucucauugu

SEQ ID NO: 537687 - RNA, 32 nt, Human
uucuucuccgguagccucucccaccuaaccuc

SEQ ID NO: 537688 - RNA, 32 nt, Human
uucuucuccuccuccuccuuccuuccuccucc

SEQ ID NO: 537689 - RNA, 32 nt, Human
uucuucuccugccucuagccucuccuggaaag

SEQ ID NO: 537690 - RNA, 32 nt, Human
uucuucuccuuucugcugaccagaaugugagc

SEQ ID NO: 537691 - RNA, 32 nt, Human
uucuucucuggcuuccucuccuucugguccua

SEQ ID NO: 537692 - RNA, 32 nt, Human
uucuucucuucccauucuuccuuacccugccu

SEQ ID NO: 537693 - RNA, 32 nt, Human
uucuucugauggcuauuccuccaccuuauucc

SEQ ID NO: 537694 - RNA, 31 nt, Human
uucuucugccucucuguguggguacugugug

SEQ ID NO: 537695 - RNA, 32 nt, Human
uucuucugccugcuaugacagcacuaaugauu

SEQ ID NO: 537696 - RNA, 32 nt, Human
uucuucugcggaaccuccaccccuccaguggg

SEQ ID NO: 537697 - RNA, 32 nt, Human
uucuucugcuuuguauaugaccuugaucuuuu

SEQ ID NO: 537698 - RNA, 32 nt, Human
uucuucugggagaacaguuggcagacagccac

SEQ ID NO: 537699 - RNA, 32 nt, Human
uucuucuggggccacccuccagccuggggcau

SEQ ID NO: 537700 - RNA, 32 nt, Human
uucuucugggucuaggccaugguacaggagaa

SEQ ID NO: 537701 - RNA, 32 nt, Human
uucuucuggugcuucucacuggacuugguggg

SEQ ID NO: 537702 - RNA, 32 nt, Human
uucuucugucaggggcacuuuccaggcuaugg

SEQ ID NO: 537703 - RNA, 32 nt, Human
uucuucugucguuucuguuccuccuccucucu

SEQ ID NO: 537704 - RNA, 32 nt, Human
uucuucugugacaauuuaucaguaucuuuacc

SEQ ID NO: 537705 - RNA, 32 nt, Human
uucuucugugcucuccucuggcuccccugucc

SEQ ID NO: 537706 - RNA, 32 nt, Human
uucuucuguugccuuuuucuuacagaaugacu

SEQ ID NO: 537707 - RNA, 32 nt, Human
uucuucuuauugcccaggcuugagugcaauga

SEQ ID NO: 537708 - RNA, 32 nt, Human
uucuucuucaaaccuuugugugcggagucauu

SEQ ID NO: 537709 - RNA, 32 nt, Human
uucuucuucacauccauugucucuucaugucu

SEQ ID NO: 537710 - RNA, 32 nt, Human
uucuucuuccacugcaaacuccuaugcagccg

SEQ ID NO: 537711 - RNA, 32 nt, Human
uucuucuuccuccaccacagaugaggacucuu

SEQ ID NO: 537712 - RNA, 32 nt, Human
uucuucuucgcuuccuccucucccaagcaaug

SEQ ID NO: 537713 - RNA, 32 nt, Human
uucuucuucuaagaagacauuuuguuacauaa

SEQ ID NO: 537714 - RNA, 32 nt, Human
uucuucuucuagaauccccacagggaaauacu

SEQ ID NO: 537715 - RNA, 32 nt, Human
uucuucuucuccccacucucccaggcaaccug

SEQ ID NO: 537716 - RNA, 32 nt, Human
uucuucuucucccuuuccaucuuucagcauag

SEQ ID NO: 537717 - RNA, 32 nt, Human
uucuucuucucugccucuccugccucucgccg

SEQ ID NO: 537718 - RNA, 32 nt, Human
uucuucuucucuucucugcaaugcuucuguag

SEQ ID NO: 537719 - RNA, 32 nt, Human
uucuucuucuucuacaacuggaaccagccauu

SEQ ID NO: 537720 - RNA, 32 nt, Human
uucuucuucuucuucuuccucuuccauaguug

SEQ ID NO: 537721 - RNA, 32 nt, Human
uucuucuucuucuucuucuucuucuucuuugg

SEQ ID NO: 537722 - RNA, 32 nt, Human
uucuucuucuucuucuucuucuucuuuggucc

SEQ ID NO: 537723 - RNA, 32 nt, Human
uucuucuucuucuucuucuucuuugguccuua

SEQ ID NO: 537724 - RNA, 32 nt, Human
uucuucuucuucuucuucuuugguccuuaagu

SEQ ID NO: 537725 - RNA, 32 nt, Human
uucuucuucuucuucuuugguccuuaagugaa

SEQ ID NO: 537726 - RNA, 32 nt, Human
uucuucuucuucuucuuuugugguuucacaua

SEQ ID NO: 537727 - RNA, 32 nt, Human
uucuucuucuucuuugguccuuaagugaaaua

SEQ ID NO: 537728 - RNA, 32 nt, Human
uucuucuucuucuuuugugguuucacauagca

SEQ ID NO: 537729 - RNA, 32 nt, Human
uucuucuugcagaaugugcucugguggaacaa

SEQ ID NO: 537730 - RNA, 32 nt, Human
uucuucuuggcucaccaacccugcaggccuca

SEQ ID NO: 537731 - RNA, 32 nt, Human
uucuucuuggcugguucuuuguucuguccccc

SEQ ID NO: 537732 - RNA, 32 nt, Human
uucuucuuguagcucuguguaagcagguggau

SEQ ID NO: 537733 - RNA, 32 nt, Human
uucuucuugugucuuugguggggauggggagg

SEQ ID NO: 537734 - RNA, 32 nt, Human
uucuucuuucuuucuuuugcaggaguuugugg

SEQ ID NO: 537735 - RNA, 32 nt, Human
uucuucuuuguaucucccuccuucccagccca

SEQ ID NO: 537736 - RNA, 32 nt, Human
uucuucuuuguuguucuucuagugugacuuuu

SEQ ID NO: 537737 - RNA, 32 nt, Human
uucuucuuuuugaguuccgcaacuugcuccug

SEQ ID NO: 537738 - RNA, 32 nt, Human
uucuugaaaaagaagaaaccugaagaugccuu

SEQ ID NO: 537739 - RNA, 32 nt, Human
uucuugaaagacagcuggcuguggagagccuu

SEQ ID NO: 537740 - RNA, 32 nt, Human
uucuugaacuccuggccaacauggugaaaccc

SEQ ID NO: 537741 - RNA, 32 nt, Human
uucuugaagaaagaagaagaugccacugccau

SEQ ID NO: 537742 - RNA, 32 nt, Human
uucuugaagcagcuccugcaaaagggaugcaa

SEQ ID NO: 537743 - RNA, 32 nt, Human
uucuugaagcugggcugucucucuccauguug

SEQ ID NO: 537744 - RNA, 32 nt, Human
uucuugaauguaaaagauagucuuccaaagga

SEQ ID NO: 537745 - RNA, 23 nt, Human
uucuugaauuauaucugcauuua

SEQ ID NO: 537746 - RNA, 32 nt, Human
uucuugacaauggggucaggccccagaggagc

SEQ ID NO: 537747 - RNA, 32 nt, Human
uucuugaccagaaccugcugugcgcuucacag

SEQ ID NO: 537748 - RNA, 32 nt, Human
uucuugaccugaggggugauuucuuggguaug

SEQ ID NO: 537749 - RNA, 32 nt, Human
uucuugacuaaaaggccagcuggcaccucugu

SEQ ID NO: 537750 - RNA, 32 nt, Human
uucuugacucacuaucacuuuaccucaaauug

SEQ ID NO: 537751 - RNA, 32 nt, Human
uucuugacucuugguucccuguuaacucuguu

SEQ ID NO: 537752 - RNA, 21 nt, Human
uucuugacugaaggugagaug

SEQ ID NO: 537753 - RNA, 24 nt, Human
uucuugagaauaaagccacugggc

SEQ ID NO: 537754 - RNA, 32 nt, Human
uucuugagaauaagcaaugggucagaugaaau

SEQ ID NO: 537755 - RNA, 32 nt, Human
uucuugagacuacccucggccuccaggucuuu

SEQ ID NO: 537756 - RNA, 32 nt, Human
uucuugagacugagucucucccuguugcccaa

SEQ ID NO: 537757 - RNA, 32 nt, Human
uucuugagagaaggagaggaagauacagcaga

SEQ ID NO: 537758 - RNA, 32 nt, Human
uucuugagaggaaguuauagaaggcuuguugg

SEQ ID NO: 537759 - RNA, 32 nt, Human
uucuugagauggagucucucugcacuccagcc

SEQ ID NO: 537760 - RNA, 32 nt, Human
uucuugagauucuaagucccacaaacauuuac

SEQ ID NO: 537761 - RNA, 32 nt, Human
uucuugagcuaaagacaggcuuuuuccaccgg

SEQ ID NO: 537762 - RNA, 32 nt, Human
uucuugagguacucugcacauacgcaccacau

SEQ ID NO: 537763 - RNA, 32 nt, Human
uucuugagguaguuaaggauuaaaaccagaaa

SEQ ID NO: 537764 - RNA, 32 nt, Human
uucuugaggucucuuuucucugcuccaugguu

SEQ ID NO: 537765 - RNA, 32 nt, Human
uucuugaggucuugagggaauagugaaacaca

SEQ ID NO: 537766 - RNA, 32 nt, Human
uucuugagucccugagaaugccuagcaaaguc

SEQ ID NO: 537767 - RNA, 24 nt, Human
uucuugauuagcuuugugauguaa

SEQ ID NO: 537768 - RNA, 32 nt, Human
uucuugauucauccauggacccugcacgaaau

SEQ ID NO: 537769 - RNA, 31 nt, Human
uucuugcacagcuaauagaagacaaaguuga

SEQ ID NO: 537770 - RNA, 32 nt, Human
uucuugcaccucagcagcugaaggucucagag

SEQ ID NO: 537771 - RNA, 32 nt, Human
uucuugcacgcgcucccugccugggcacacca

SEQ ID NO: 537772 - RNA, 32 nt, Human
uucuugcagcuaagcaagacagccauaugaug

SEQ ID NO: 537773 - RNA, 32 nt, Human
uucuugcaguguuguugcaaaugcagagcuau

SEQ ID NO: 537774 - RNA, 32 nt, Human
uucuugcaucuggccuuagaaaugugaaguua

SEQ ID NO: 537775 - RNA, 32 nt, Human
uucuugcauggcccaagauguauuucccugug

SEQ ID NO: 537776 - RNA, 32 nt, Human
uucuugccaauuucacacuuguaucuucagca

SEQ ID NO: 537777 - RNA, 32 nt, Human
uucuugccacaucuucucagaagacuuucagg

SEQ ID NO: 537778 - RNA, 32 nt, Human
uucuugccaccugcaaccccaaucucaauccg

SEQ ID NO: 537779 - RNA, 32 nt, Human
uucuugccaggaggaggaaugagagugauguu

SEQ ID NO: 537780 - RNA, 32 nt, Human
uucuugccaucagaagggacagaaggagaugg

SEQ ID NO: 537781 - RNA, 32 nt, Human
uucuugccaucguagagcacaccagaagcagg

SEQ ID NO: 537782 - RNA, 32 nt, Human
uucuugcccaggcagagagagcaggagcggac

SEQ ID NO: 537783 - RNA, 32 nt, Human
uucuugcccaggcuggaguacaauggugcgau

SEQ ID NO: 537784 - RNA, 32 nt, Human
uucuugcccaggcuggagugcaagggcgcaau

SEQ ID NO: 537785 - RNA, 32 nt, Human
uucuugcccucucuuuugaggcucucucauaa

SEQ ID NO: 537786 - RNA, 32 nt, Human
uucuugcccuuuucagcagcuugcccagcucu

SEQ ID NO: 537787 - RNA, 32 nt, Human
uucuugccguggcucuuccuccucccucagcg

SEQ ID NO: 537788 - RNA, 32 nt, Human
uucuugccuaguguccagagcagcagagauuu

SEQ ID NO: 537789 - RNA, 32 nt, Human
uucuugccucaccauuccccuaggcaggcccu

SEQ ID NO: 537790 - RNA, 32 nt, Human
uucuugccucccugaccagcagacucaccucc

SEQ ID NO: 537791 - RNA, 32 nt, Human
uucuugccuguaacccuagcacuuugggaggc

SEQ ID NO: 537792 - RNA, 32 nt, Human
uucuugccuucaugcuuggcccucucuccuca

SEQ ID NO: 537793 - RNA, 32 nt, Human
uucuugcuauauugccccaggcuggucucgaa

SEQ ID NO: 537794 - RNA, 32 nt, Human
uucuugcucacugcucacccaccugcugcugc

SEQ ID NO: 537795 - RNA, 32 nt, Human
uucuugcucauaugcagaaaagugagaugggg

SEQ ID NO: 537796 - RNA, 32 nt, Human
uucuugcucaucccuucucccuuucacuucug

SEQ ID NO: 537797 - RNA, 32 nt, Human
uucuugcuccaaucccuaccaauaaugucaug

SEQ ID NO: 537798 - RNA, 32 nt, Human
uucuugcuccuguucucagccuguuaucuggc

SEQ ID NO: 537799 - RNA, 32 nt, Human
uucuugcuccuucuucaacuccuggugugugu

SEQ ID NO: 537800 - RNA, 32 nt, Human
uucuugcucucccaggcuggagugcaguggug

SEQ ID NO: 537801 - RNA, 32 nt, Human
uucuugcugcagccugcuccagccuggccccc

SEQ ID NO: 537802 - RNA, 32 nt, Human
uucuugcugcugcugccugccugcccacccgc

SEQ ID NO: 537803 - RNA, 21 nt, Human
uucuugcugcugugacugcaa

SEQ ID NO: 537804 - RNA, 32 nt, Human
uucuugcuggaugacccacuguccgcggugga

SEQ ID NO: 537805 - RNA, 32 nt, Human
uucuugcuucaguuggggcagacucugauccc

SEQ ID NO: 537806 - RNA, 31 nt, Human
uucuugcuuucaauaucuuguugaaauaaaa

SEQ ID NO: 537807 - RNA, 32 nt, Human
uucuugcuuuccuggggagggagggagggaug

SEQ ID NO: 537808 - RNA, 32 nt, Human
uucuugcuuuggcugagagcagccucuuuuua

SEQ ID NO: 537809 - RNA, 32 nt, Human
uucuugcuuuuccuucucauugcccuuuucag

SEQ ID NO: 537810 - RNA, 31 nt, Human
uucuugcuuuucugugggccugaagguccga

SEQ ID NO: 537811 - RNA, 32 nt, Human
uucuuggaaaaacacagacagcaauggaucaa

SEQ ID NO: 537812 - RNA, 32 nt, Human
uucuuggaaauaucucaaauguuaauaacaau

SEQ ID NO: 537813 - RNA, 32 nt, Human
uucuuggacagaaaccauccaugaauuuagca

SEQ ID NO: 537814 - RNA, 32 nt, Human
uucuuggagaacacuggacagcugaauaaaug

SEQ ID NO: 537815 - RNA, 32 nt, Human
uucuuggagccucacugucuucaucuguuaag

SEQ ID NO: 537816 - RNA, 32 nt, Human
uucuuggaggaggugggacuugagcuggaccc

SEQ ID NO: 537817 - RNA, 32 nt, Human
uucuuggaggcgacaacccccgggaggcauua

SEQ ID NO: 537818 - RNA, 32 nt, Human
uucuuggagguagaagucgaguaugaggcagu

SEQ ID NO: 537819 - RNA, 32 nt, Human
uucuuggaugcaucuucuuccuucccuuuccu

SEQ ID NO: 537820 - RNA, 32 nt, Human
uucuuggcacaucuguaaugagaacuugucug

SEQ ID NO: 537821 - RNA, 32 nt, Human
uucuuggcagagagaagaggggacaaauuugg

SEQ ID NO: 537822 - RNA, 32 nt, Human
uucuuggcaggagagcccucagcuggagaagc

SEQ ID NO: 537823 - RNA, 32 nt, Human
uucuuggccaagcagaugacaacacaucuccu

SEQ ID NO: 537824 - RNA, 32 nt, Human
uucuuggccaggcuguaggugguggcucacau

SEQ ID NO: 537825 - RNA, 32 nt, Human
uucuuggccaugacaggacaggaagucagaca

SEQ ID NO: 537826 - RNA, 32 nt, Human
uucuuggcccuccucugcuccuccccacaccc

SEQ ID NO: 537827 - RNA, 32 nt, Human
uucuuggccucugcucagcuacucuggucuug

SEQ ID NO: 537828 - RNA, 32 nt, Human
uucuuggcucacugcacccuccgccuccuggg

SEQ ID NO: 537829 - RNA, 19 nt, Human
uucuuggcucaucugguca

SEQ ID NO: 537830 - RNA, 32 nt, Human
uucuuggcuccuuuucuccauuuccuuugggg

SEQ ID NO: 537831 - RNA, 28 nt, Human
uucuuggcucggcggcgcucggggccug

SEQ ID NO: 537832 - RNA, 32 nt, Human
uucuuggcuugucugcaguauauacauuuaau

SEQ ID NO: 537833 - RNA, 32 nt, Human
uucuugggaauuuugcuuuuugucuucccuuc

SEQ ID NO: 537834 - RNA, 32 nt, Human
uucuugggacccuccucucucccucacugcuc

SEQ ID NO: 537835 - RNA, 32 nt, Human
uucuugggagagaggggaagagucgggacuug

SEQ ID NO: 537836 - RNA, 32 nt, Human
uucuugggagccaagagaaugcaagauccugg

SEQ ID NO: 537837 - RNA, 32 nt, Human
uucuugggcagcagggaggcagcucuggaggg

SEQ ID NO: 537838 - RNA, 32 nt, Human
uucuugggccaucugaggguuccugagcccaa

SEQ ID NO: 537839 - RNA, 32 nt, Human
uucuugggccccacuccagggugucgcggggg

SEQ ID NO: 537840 - RNA, 32 nt, Human
uucuugggccgcgcucccucccuaccugggug

SEQ ID NO: 537841 - RNA, 22 nt, Human
uucuugggccucugggcacaga

SEQ ID NO: 537842 - RNA, 32 nt, Human
uucuugggccuggagguuagcagucaaguuuc

SEQ ID NO: 537843 - RNA, 32 nt, Human
uucuugggcugccaaauuucagcuaagcauca

SEQ ID NO: 537844 - RNA, 32 nt, Human
uucuugggguagagcgugaaauccagaccugu

SEQ ID NO: 537845 - RNA, 32 nt, Human
uucuuggguauuggggacaggacagagagcuc

SEQ ID NO: 537846 - RNA, 32 nt, Human
uucuuggguguuuauccuaucucuccaaccag

SEQ ID NO: 537847 - RNA, 23 nt, Human
uucuugguacugggaggcugcag

SEQ ID NO: 537848 - RNA, 24 nt, Human
uucuugguaguaagauaacuguag

SEQ ID NO: 537849 - RNA, 23 nt, Human
uucuuggucagagguagcugcag

SEQ ID NO: 537850 - RNA, 22 nt, Human
uucuuggucuuuugugacgcag

SEQ ID NO: 537851 - RNA, 32 nt, Human
uucuuggugaguuauugugggaaaaauccugu

SEQ ID NO: 537852 - RNA, 32 nt, Human
uucuuggugccaucuuccccugccgcaccggc

SEQ ID NO: 537853 - RNA, 32 nt, Human
uucuuggugccuuauugguuuuccuugcaaac

SEQ ID NO: 537854 - RNA, 32 nt, Human
uucuuggugggaacaugaaugagaaaugaugc

SEQ ID NO: 537855 - RNA, 32 nt, Human
uucuugguguuaucuuuucucagaauaaaauu

SEQ ID NO: 537856 - RNA, 24 nt, Human
uucuugguguuguuguaacuggag

SEQ ID NO: 537857 - RNA, 32 nt, Human
uucuugguuuaugucuuguucuugagauuuug

SEQ ID NO: 537858 - RNA, 32 nt, Human
uucuugguuugcuccuuggauuccccuuccca

SEQ ID NO: 537859 - RNA, 32 nt, Human
uucuuguaccccuuugcaguucaucagccuuu

SEQ ID NO: 537860 - RNA, 32 nt, Human
uucuuguaccccuuugcaguucaucagucuuu

SEQ ID NO: 537861 - RNA, 32 nt, Human
uucuuguagggagaaaugagaaaucgcauuug

SEQ ID NO: 537862 - RNA, 32 nt, Human
uucuuguagugccagucuaaugguuaugaauu

SEQ ID NO: 537863 - RNA, 32 nt, Human
uucuuguauacuuagcuuacugcccagaugca

SEQ ID NO: 537864 - RNA, 31 nt, Human
uucuuguaucugcugcugccuguguuuuucu

SEQ ID NO: 537865 - RNA, 32 nt, Human
uucuugucacccagacuggagugcgauggcac

SEQ ID NO: 537866 - RNA, 32 nt, Human
uucuugucacccugggacaguaaugccuuaua

SEQ ID NO: 537867 - RNA, 32 nt, Human
uucuugucccccaggcuugagugcaaugacuc

SEQ ID NO: 537868 - RNA, 32 nt, Human
uucuuguccuggggcccccuugagcugugaac

SEQ ID NO: 537869 - RNA, 32 nt, Human
uucuugucuccucuaauaagccccacccuccc

SEQ ID NO: 537870 - RNA, 32 nt, Human
uucuugucuccucuucagaauuagccauuuaa

SEQ ID NO: 537871 - RNA, 32 nt, Human
uucuugucuuggcacaugcacagacccagucc

SEQ ID NO: 537872 - RNA, 32 nt, Human
uucuugugcuaaaucucucucacagucccccu

SEQ ID NO: 537873 - RNA, 32 nt, Human
uucuuguggaccugucuguuacggagucacac

SEQ ID NO: 537874 - RNA, 32 nt, Human
uucuugugugccucccuuuccuuucccuccca

SEQ ID NO: 537875 - RNA, 32 nt, Human
uucuugugugucccucggguuuggggcucuuc

SEQ ID NO: 537876 - RNA, 32 nt, Human
uucuuguucaggacugacacagccacaguuuc

SEQ ID NO: 537877 - RNA, 32 nt, Human
uucuuguucauuuugcauuccugcagucagug

SEQ ID NO: 537878 - RNA, 32 nt, Human
uucuuguucuuucugacucaggugacuuuuca

SEQ ID NO: 537879 - RNA, 32 nt, Human
uucuuguucuuugcaccucucucuccaccccu

SEQ ID NO: 537880 - RNA, 32 nt, Human
uucuuguugcccaaccuggagugcaguggugc

SEQ ID NO: 537881 - RNA, 32 nt, Human
uucuuguugcccaggcugcagugcaauggcac

SEQ ID NO: 537882 - RNA, 32 nt, Human
uucuuguugcccaggcuggaaugcaauggcgc

SEQ ID NO: 537883 - RNA, 32 nt, Human
uucuuguugcccagggcuggagugcaguggca

SEQ ID NO: 537884 - RNA, 32 nt, Human
uucuuguugccgaggcuggagugcaauggcgc

SEQ ID NO: 537885 - RNA, 32 nt, Human
uucuuguugccuaggcuggagugcaauggcga

SEQ ID NO: 537886 - RNA, 32 nt, Human
uucuuguuucuccaauuuucaaggaaauaaac

SEQ ID NO: 537887 - RNA, 32 nt, Human
uucuuuaaaauuggauugucuggugaguuuug

SEQ ID NO: 537888 - RNA, 32 nt, Human
uucuuuaaacauggagucuaaauauguaauau

SEQ ID NO: 537889 - RNA, 32 nt, Human
uucuuuaaagaaugcuggguguugcauuucug

SEQ ID NO: 537890 - RNA, 32 nt, Human
uucuuuaaaguuaggaaagggaguaggcaggc

SEQ ID NO: 537891 - RNA, 32 nt, Human
uucuuuaaccacacucuaaaaguucuucagac

SEQ ID NO: 537892 - RNA, 32 nt, Human
uucuuuaaccuccuaaauauuggugggaagac

SEQ ID NO: 537893 - RNA, 32 nt, Human
uucuuuaagugcugggaguauuaccauaauaa

SEQ ID NO: 537894 - RNA, 32 nt, Human
uucuuuaaucuaguaugguuacuccagauaag

SEQ ID NO: 537895 - RNA, 32 nt, Human
uucuuuaaucucuguuuucacucucaggcucu

SEQ ID NO: 537896 - RNA, 32 nt, Human
uucuuuaaugaaauccuccucacuuccaucac

SEQ ID NO: 537897 - RNA, 21 nt, Human
uucuuuacaaaggaaaauggc

SEQ ID NO: 537898 - RNA, 32 nt, Human
uucuuuacagauuccagcaagauuauggaaga

SEQ ID NO: 537899 - RNA, 32 nt, Human
uucuuuaccucauuaucaccuuccccucacac

SEQ ID NO: 537900 - RNA, 32 nt, Human
uucuuuacuauuuaaaauacuacacauuguac

SEQ ID NO: 537901 - RNA, 32 nt, Human
uucuuuacugacuugauucagucacucguagc

SEQ ID NO: 537902 - RNA, 32 nt, Human
uucuuuagagagaagcggggaguggguuaacu

SEQ ID NO: 537903 - RNA, 32 nt, Human
uucuuuagagagcagaagcagaagaguaaaau

SEQ ID NO: 537904 - RNA, 32 nt, Human
uucuuuagagcauuugcuucacacacaguuca

SEQ ID NO: 537905 - RNA, 32 nt, Human
uucuuuagauggagucucacucugucacccag

SEQ ID NO: 537906 - RNA, 32 nt, Human
uucuuuagaugguggcacauuccuuuggguau

SEQ ID NO: 537907 - RNA, 32 nt, Human
uucuuuaggaagagccagacugccugugaagg

SEQ ID NO: 537908 - RNA, 32 nt, Human
uucuuuaggcaucacacacagccccggcacac

SEQ ID NO: 537909 - RNA, 32 nt, Human
uucuuuagggagugcuucuggggaacccauug

SEQ ID NO: 537910 - RNA, 21 nt, Human
uucuuuaggguccagaaggaa

SEQ ID NO: 537911 - RNA, 32 nt, Human
uucuuuagguauaagaaaaagaugaaugauga

SEQ ID NO: 537912 - RNA, 32 nt, Human
uucuuuaguaaagacaggguuucuccauguug

SEQ ID NO: 537913 - RNA, 32 nt, Human
uucuuuaucuucuaugaagggucuguaaugaa

SEQ ID NO: 537914 - RNA, 32 nt, Human
uucuuuauguacaaagauuauuugcacgaacu

SEQ ID NO: 537915 - RNA, 32 nt, Human
uucuuuauguauauuuguagcuauauuucaua

SEQ ID NO: 537916 - RNA, 32 nt, Human
uucuuuauguguuucauuacagcuccaaaaag

SEQ ID NO: 537917 - RNA, 32 nt, Human
uucuuuauucagauaagaucucagccaaaagg

SEQ ID NO: 537918 - RNA, 32 nt, Human
uucuuuauuccucuuucuucugaagauuaaug

SEQ ID NO: 537919 - RNA, 32 nt, Human
uucuuuauuccuucuuuucucccaacuacugu

SEQ ID NO: 537920 - RNA, 31 nt, Human
uucuuuauucugugacaccuguugaaugagg

SEQ ID NO: 537921 - RNA, 32 nt, Human
uucuuuauuuauaacaugaagcacaauggauu

SEQ ID NO: 537922 - RNA, 32 nt, Human
uucuuuauuucaucuucccuauuccaucuaau

SEQ ID NO: 537923 - RNA, 29 nt, Human
uucuuuauuuugugugugccugugauguu

SEQ ID NO: 537924 - RNA, 32 nt, Human
uucuuucaaauugugugugcucugcuucaaug

SEQ ID NO: 537925 - RNA, 32 nt, Human
uucuuucaaucaucaucucucuaaaaaggccc

SEQ ID NO: 537926 - RNA, 32 nt, Human
uucuuucaccuuugaaacaaugguuuguagca

SEQ ID NO: 537927 - RNA, 32 nt, Human
uucuuucacugacacccaccucuaaggacuca

SEQ ID NO: 537928 - RNA, 32 nt, Human
uucuuucacugugcuacuaugugguuuuuaaa

SEQ ID NO: 537929 - RNA, 32 nt, Human
uucuuucagcuuuacagaacuguauuauaagu

SEQ ID NO: 537930 - RNA, 32 nt, Human
uucuuucauacuggcuaucauggcuuccacug

SEQ ID NO: 537931 - RNA, 32 nt, Human
uucuuuccacacucagcucucccuccucaacc

SEQ ID NO: 537932 - RNA, 32 nt, Human
uucuuuccacgcuuuccagccugugggagcgg

SEQ ID NO: 537933 - RNA, 32 nt, Human
uucuuuccacuccuauuacaacugaucugauu

SEQ ID NO: 537934 - RNA, 32 nt, Human
uucuuuccagaagaggagacaaaagcaagaua

SEQ ID NO: 537935 - RNA, 32 nt, Human
uucuuuccagaccugcuccugcugcacagagc

SEQ ID NO: 537936 - RNA, 32 nt, Human
uucuuuccaggccuuucccaaggaguagcuga

SEQ ID NO: 537937 - RNA, 32 nt, Human
uucuuuccaucuuuagaaacaucaguuuuugu

SEQ ID NO: 537938 - RNA, 32 nt, Human
uucuuuccauuggaaacaguugcuugaaguag

SEQ ID NO: 537939 - RNA, 32 nt, Human
uucuuuccauuuuucuucugggaaaauagcag

SEQ ID NO: 537940 - RNA, 19 nt, Human
uucuuucccaggcaccaca

SEQ ID NO: 537941 - RNA, 32 nt, Human
uucuuucccauguuguauugcauuuuuggggg

SEQ ID NO: 537942 - RNA, 32 nt, Human
uucuuucccuuucccuuucuuuucuuucuuua

SEQ ID NO: 537943 - RNA, 32 nt, Human
uucuuucccuuucucuuucuaucucucuuuau

SEQ ID NO: 537944 - RNA, 32 nt, Human
uucuuuccuagccugaguguugagcaguguca

SEQ ID NO: 537945 - RNA, 32 nt, Human
uucuuuccucaaggagacuccagcaccuaugc

SEQ ID NO: 537946 - RNA, 32 nt, Human
uucuuuccucaccccaaccuuuacuccaccag

SEQ ID NO: 537947 - RNA, 32 nt, Human
uucuuuccuccacaucuucccucaagcugcuc

SEQ ID NO: 537948 - RNA, 32 nt, Human
uucuuuccuccaccccuccaucccccaaugcu

SEQ ID NO: 537949 - RNA, 32 nt, Human
uucuuuccucuccaaagccucagucuagccug

SEQ ID NO: 537950 - RNA, 32 nt, Human
uucuuuccucuuuccccugccugugugcccuu

SEQ ID NO: 537951 - RNA, 32 nt, Human
uucuuuccuggguuuugguguugugggauccc

SEQ ID NO: 537952 - RNA, 32 nt, Human
uucuuuccuuccugccuuuuagcucuaaccac

SEQ ID NO: 537953 - RNA, 32 nt, Human
uucuuuccuucuucccucccugccucccuuuc

SEQ ID NO: 537954 - RNA, 32 nt, Human
uucuuucguuugcccuucuuccuuccuguguu

SEQ ID NO: 537955 - RNA, 32 nt, Human
uucuuucuaacuacaugcaucucuccacucaa

SEQ ID NO: 537956 - RNA, 32 nt, Human
uucuuucuacucucuucucuuccccaaggccu

SEQ ID NO: 537957 - RNA, 32 nt, Human
uucuuucuauucagcuucuaagugggcuauuc

SEQ ID NO: 537958 - RNA, 32 nt, Human
uucuuucucacccaggcaaucuugccuucugg

SEQ ID NO: 537959 - RNA, 32 nt, Human
uucuuucuccacccacucaguugucuagaaga

SEQ ID NO: 537960 - RNA, 32 nt, Human
uucuuucuccuccagcugaaucagcuggaucc

SEQ ID NO: 537961 - RNA, 32 nt, Human
uucuuucucuauaacuaacacagggaucacug

SEQ ID NO: 537962 - RNA, 32 nt, Human
uucuuucucuccccguuucucuccccaucuug

SEQ ID NO: 537963 - RNA, 32 nt, Human
uucuuucucucccucccuccuuaugugccaag

SEQ ID NO: 537964 - RNA, 32 nt, Human
uucuuucugcaaccuguacuuacagauucuuc

SEQ ID NO: 537965 - RNA, 32 nt, Human
uucuuucugcucccucauucucuccccaccac

SEQ ID NO: 537966 - RNA, 32 nt, Human
uucuuucugcuuuccaagacuccaggaaaaac

SEQ ID NO: 537967 - RNA, 32 nt, Human
uucuuucuguaggaaaaguucugugaggaugg

SEQ ID NO: 537968 - RNA, 24 nt, Human
uucuuucuguccauaacugaagua

SEQ ID NO: 537969 - RNA, 32 nt, Human
uucuuucuguguuucacauucauagcaacugc

SEQ ID NO: 537970 - RNA, 32 nt, Human
uucuuucuguuuucuuuuacucugcuuacauu

SEQ ID NO: 537971 - RNA, 32 nt, Human
uucuuucuuaccuucucuccucuugucauuca

SEQ ID NO: 537972 - RNA, 32 nt, Human
uucuuucuuauuguggagcguccccuuccauc

SEQ ID NO: 537973 - RNA, 32 nt, Human
uucuuucuucacucugaaguagcuggugguac

SEQ ID NO: 537974 - RNA, 32 nt, Human
uucuuucuucuggcuuuggaaaaaucucauga

SEQ ID NO: 537975 - RNA, 32 nt, Human
uucuuucuucuucucuccuuuuccuaucaucc

SEQ ID NO: 537976 - RNA, 32 nt, Human
uucuuucuucuuuucucucccuuccuucuucc

SEQ ID NO: 537977 - RNA, 32 nt, Human
uucuuucuuucagccugaauucuaagcaacaa

SEQ ID NO: 537978 - RNA, 32 nt, Human
uucuuucuuucauuccuuccuuccucuguuuc

SEQ ID NO: 537979 - RNA, 32 nt, Human
uucuuucuuucuccuuccuuccuuccucuuuc

SEQ ID NO: 537980 - RNA, 32 nt, Human
uucuuucuuuuccugguagauaggaucuuuuc

SEQ ID NO: 537981 - RNA, 32 nt, Human
uucuuucuuuucuauuucuccgugucagaaug

SEQ ID NO: 537982 - RNA, 32 nt, Human
uucuuugaacccaggaggcagagguugcagug

SEQ ID NO: 537983 - RNA, 32 nt, Human
uucuuugaagauugggaaggcucagaagggca

SEQ ID NO: 537984 - RNA, 18 nt, Human
uucuuugaaucuuccuua

SEQ ID NO: 537985 - RNA, 32 nt, Human
uucuuugaccggcuugucauccuuacgccacu

SEQ ID NO: 537986 - RNA, 32 nt, Human
uucuuugacuccaagccuuaaaauacucacau

SEQ ID NO: 537987 - RNA, 32 nt, Human
uucuuugacuccuguggcccucgcugcuuuac

SEQ ID NO: 537988 - RNA, 32 nt, Human
uucuuugagaaacccuaacacuggcuucauuu

SEQ ID NO: 537989 - RNA, 32 nt, Human
uucuuugagacaaggcaggcuguggccaugua

SEQ ID NO: 537990 - RNA, 32 nt, Human
uucuuugagacuauuuaaaaacugguacaaca

SEQ ID NO: 537991 - RNA, 32 nt, Human
uucuuugagaugaagucucccucuuguuaccc

SEQ ID NO: 537992 - RNA, 32 nt, Human
uucuuugagauggagucucgcucugucaccca

SEQ ID NO: 537993 - RNA, 32 nt, Human
uucuuugagauggagucuugcucugucaccca

SEQ ID NO: 537994 - RNA, 32 nt, Human
uucuuugaugccacuggccacuguaucugcuu

SEQ ID NO: 537995 - RNA, 32 nt, Human
uucuuugcaggaggagaagagaaggggugcaa

SEQ ID NO: 537996 - RNA, 32 nt, Human
uucuuugcccagaguugcaguuguacuguugc

SEQ ID NO: 537997 - RNA, 32 nt, Human
uucuuugccugagauccuuccugaggagcguc

SEQ ID NO: 537998 - RNA, 32 nt, Human
uucuuugccuugagccucaucacucagaagcc

SEQ ID NO: 537999 - RNA, 32 nt, Human
uucuuugcuauccucugccuucccaagucccu

SEQ ID NO: 538000 - RNA, 32 nt, Human
uucuuugcuccucucugcuccaauaccaccac

SEQ ID NO: 538001 - RNA, 32 nt, Human
uucuuuggagaacagaaagaagaaaggaaaga

SEQ ID NO: 538002 - RNA, 32 nt, Human
uucuuuggaggaagauuggaggcuggugcuca

SEQ ID NO: 538003 - RNA, 32 nt, Human
uucuuuggaucccagagggccuugauccuggg

SEQ ID NO: 538004 - RNA, 32 nt, Human
uucuuuggcaauagcccagucuggacuuacua

SEQ ID NO: 538005 - RNA, 32 nt, Human
uucuuuggcugcagaguggccuggccaacuca

SEQ ID NO: 538006 - RNA, 23 nt, Human
uucuuuggggauggggagcucuu

SEQ ID NO: 538007 - RNA, 32 nt, Human
uucuuuggggcucucggcugggcgcaguggcu

SEQ ID NO: 538008 - RNA, 32 nt, Human
uucuuuggggguggaaaaggaaaacaauucaa

SEQ ID NO: 538009 - RNA, 32 nt, Human
uucuuugggguuuuuguuuguuuucccccauu

SEQ ID NO: 538010 - RNA, 32 nt, Human
uucuuugguacacaguucugguguuccuacca

SEQ ID NO: 538011 - RNA, 32 nt, Human
uucuuugguacuugcuuauaaagugauaguac

SEQ ID NO: 538012 - RNA, 32 nt, Human
uucuuugguagaaauagcuuuugcuuuauauu

SEQ ID NO: 538013 - RNA, 32 nt, Human
uucuuugguuugcuuucuucaggcucuagggc

SEQ ID NO: 538014 - RNA, 32 nt, Human
uucuuugguuuugguuuguaagauccaucaaa

SEQ ID NO: 538015 - RNA, 32 nt, Human
uucuuuguaaagcauccucuaccucucagcug

SEQ ID NO: 538016 - RNA, 32 nt, Human
uucuuuguaccucccuccucucccucacucau

SEQ ID NO: 538017 - RNA, 32 nt, Human
uucuuuguaggcgccaucagccacuuuuagaa

SEQ ID NO: 538018 - RNA, 32 nt, Human
uucuuuguauaacuuuuccaagcuuuuacauu

SEQ ID NO: 538019 - RNA, 32 nt, Human
uucuuuguauuuuuaucucuaucuccucacuu

SEQ ID NO: 538020 - RNA, 32 nt, Human
uucuuugucaacuuaauuguuauggauguuug

SEQ ID NO: 538021 - RNA, 32 nt, Human
uucuuugucccaggauucauggacgcuucggg

SEQ ID NO: 538022 - RNA, 32 nt, Human
uucuuugucuuaucuggggaaggaaaguauaa

SEQ ID NO: 538023 - RNA, 32 nt, Human
uucuuugugcuucucauuuuuccuuuguugau

SEQ ID NO: 538024 - RNA, 32 nt, Human
uucuuuguggagccucucagugugggcagccc

SEQ ID NO: 538025 - RNA, 32 nt, Human
uucuuuguucaccucuacuugccucuaaaaua

SEQ ID NO: 538026 - RNA, 32 nt, Human
uucuuuguugacugaaaaagcgagaaagguga

SEQ ID NO: 538027 - RNA, 32 nt, Human
uucuuuguuuucuuccuuuaucguuuuuaggu

SEQ ID NO: 538028 - RNA, 32 nt, Human
uucuuuuaacaauuugaccucucuccaaaaca

SEQ ID NO: 538029 - RNA, 32 nt, Human
uucuuuuaagcaaugaggaaagagaugacuuu

SEQ ID NO: 538030 - RNA, 30 nt, Human
uucuuuuaauaaacacacuuacaugguuac

SEQ ID NO: 538031 - RNA, 32 nt, Human
uucuuuuaaugccaccacacguguuccgcuuc

SEQ ID NO: 538032 - RNA, 32 nt, Human
uucuuuuaauuagcugggcaugguggugugcu

SEQ ID NO: 538033 - RNA, 32 nt, Human
uucuuuuaauuccccaugauguuuucaauuau

SEQ ID NO: 538034 - RNA, 32 nt, Human
uucuuuuagaagcacaugucugccaaggagug

SEQ ID NO: 538035 - RNA, 32 nt, Human
uucuuuuagagaaaccaccuuaucuauuuuua

SEQ ID NO: 538036 - RNA, 32 nt, Human
uucuuuuagcuuggaaacagucuuccacuaac

SEQ ID NO: 538037 - RNA, 22 nt, Human
uucuuuuagguugggcgguggg

SEQ ID NO: 538038 - RNA, 32 nt, Human
uucuuuuauccuuacgcugucaaaaccucuaa

SEQ ID NO: 538039 - RNA, 32 nt, Human
uucuuuuauguucacaccaccacauucccauu

SEQ ID NO: 538040 - RNA, 32 nt, Human
uucuuuuauuaugagcugcuuguuugaguggu

SEQ ID NO: 538041 - RNA, 32 nt, Human
uucuuuuauuccuucuuuacugcuuuuucauc

SEQ ID NO: 538042 - RNA, 32 nt, Human
uucuuuuauuuuccuacaauguaagcacgguu

SEQ ID NO: 538043 - RNA, 22 nt, Human
uucuuuucaauuguuugauuca

SEQ ID NO: 538044 - RNA, 32 nt, Human
uucuuuucacacaaucucuuuacagcagaauc

SEQ ID NO: 538045 - RNA, 32 nt, Human
uucuuuucacuuccucuccacaggagccucug

SEQ ID NO: 538046 - RNA, 32 nt, Human
uucuuuucagaaccccagaugagagccaaugu

SEQ ID NO: 538047 - RNA, 32 nt, Human
uucuuuucaggucauuuacaauugggagauuu

SEQ ID NO: 538048 - RNA, 32 nt, Human
uucuuuucauuugagcucugguuucgguaggg

SEQ ID NO: 538049 - RNA, 21 nt, Human
uucuuuuccaaaaauacuucu

SEQ ID NO: 538050 - RNA, 32 nt, Human
uucuuuuccaaaauaaaacaaagggcacagca

SEQ ID NO: 538051 - RNA, 32 nt, Human
uucuuuuccacccgucuuugguauguauuggc

SEQ ID NO: 538052 - RNA, 32 nt, Human
uucuuuuccaccugccccaugccuuuugguug

SEQ ID NO: 538053 - RNA, 32 nt, Human
uucuuuuccagaaauacaaugcuagguguuuu

SEQ ID NO: 538054 - RNA, 32 nt, Human
uucuuuuccagccuccagccucucauuucugg

SEQ ID NO: 538055 - RNA, 24 nt, Human
uucuuuucccauugacuauauaca

SEQ ID NO: 538056 - RNA, 22 nt, Human
uucuuuucccauugccgugaca

SEQ ID NO: 538057 - RNA, 32 nt, Human
uucuuuuccuccuucucucuuucuugcuccaa

SEQ ID NO: 538058 - RNA, 32 nt, Human
uucuuuuccucuuugggaauccaaaugaugau

SEQ ID NO: 538059 - RNA, 32 nt, Human
uucuuuuccucuuuuuccccaagaggaagaau

SEQ ID NO: 538060 - RNA, 32 nt, Human
uucuuuuccugccucagcccagcucugcaaau

SEQ ID NO: 538061 - RNA, 32 nt, Human
uucuuuuccugcucagcuucuucgagguuggc

SEQ ID NO: 538062 - RNA, 32 nt, Human
uucuuuuccuucugccuuuuugggaaagagac

SEQ ID NO: 538063 - RNA, 32 nt, Human
uucuuuucuaagccauggagugagugagcagg

SEQ ID NO: 538064 - RNA, 32 nt, Human
uucuuuucucauucccucgucuccaccgggaa

SEQ ID NO: 538065 - RNA, 32 nt, Human
uucuuuucuccucaacccagcauuuuauuuaa

SEQ ID NO: 538066 - RNA, 32 nt, Human
uucuuuucuccucccuuuuacuuugccgguag

SEQ ID NO: 538067 - RNA, 32 nt, Human
uucuuuucuccuccucucuccuuccugcuguc

SEQ ID NO: 538068 - RNA, 32 nt, Human
uucuuuucugccggguaauggcugcuuccaag

SEQ ID NO: 538069 - RNA, 32 nt, Human
uucuuuucuggagucaggauguucucggucac

SEQ ID NO: 538070 - RNA, 32 nt, Human
uucuuuucuucagacuuaaagcagaaaggggu

SEQ ID NO: 538071 - RNA, 32 nt, Human
uucuuuucuucugcuucccuugccuauuugcu

SEQ ID NO: 538072 - RNA, 23 nt, Human
uucuuuucuuuucucugguaaua

SEQ ID NO: 538073 - RNA, 32 nt, Human
uucuuuugagcagcgauugcuggaucauugau

SEQ ID NO: 538074 - RNA, 32 nt, Human
uucuuuugcccagcaggguaauauugaguccc

SEQ ID NO: 538075 - RNA, 32 nt, Human
uucuuuugcccaggcuggagugcaguggcaca

SEQ ID NO: 538076 - RNA, 32 nt, Human
uucuuuugccuagguuggaguacagcggugaa

SEQ ID NO: 538077 - RNA, 32 nt, Human
uucuuuugcuuugguuguacaugaaaguuggu

SEQ ID NO: 538078 - RNA, 32 nt, Human
uucuuuuggagcuacuuugggguggggaaacu

SEQ ID NO: 538079 - RNA, 32 nt, Human
uucuuuuggaguaucuucaucuccucucauuu

SEQ ID NO: 538080 - RNA, 32 nt, Human
uucuuuuggcagcaguggugguaguggcggug

SEQ ID NO: 538081 - RNA, 32 nt, Human
uucuuuuggccccagcccugucccucacuguc

SEQ ID NO: 538082 - RNA, 32 nt, Human
uucuuuuggccuccucguuuuccuucucuuuu

SEQ ID NO: 538083 - RNA, 32 nt, Human
uucuuuuggguggcaaugguuuggauaucguu

SEQ ID NO: 538084 - RNA, 32 nt, Human
uucuuuugguuaaauauaauuuccaaacuuug

SEQ ID NO: 538085 - RNA, 32 nt, Human
uucuuuugugaagccucuucagccuugaucau

SEQ ID NO: 538086 - RNA, 32 nt, Human
uucuuuuuaauauaaaaauuagcuaggugcag

SEQ ID NO: 538087 - RNA, 32 nt, Human
uucuuuuuagagacugagccucaguauguugc

SEQ ID NO: 538088 - RNA, 32 nt, Human
uucuuuuuauucuucucuacagcauccauuca

SEQ ID NO: 538089 - RNA, 32 nt, Human
uucuuuuucccaaagcguuuuauuugaaagga

SEQ ID NO: 538090 - RNA, 32 nt, Human
uucuuuuucccucucaauuccaaggcauugga

SEQ ID NO: 538091 - RNA, 32 nt, Human
uucuuuuucccuuuccuuuccuuucauuuucu

SEQ ID NO: 538092 - RNA, 32 nt, Human
uucuuuuucuaugagcacacucugcugcuucu

SEQ ID NO: 538093 - RNA, 32 nt, Human
uucuuuuucucaaauaugccaucauaugggau

SEQ ID NO: 538094 - RNA, 32 nt, Human
uucuuuuucuccacaucuucugaggcuuuaga

SEQ ID NO: 538095 - RNA, 32 nt, Human
uucuuuuucucccaacuucgccacucagcccc

SEQ ID NO: 538096 - RNA, 32 nt, Human
uucuuuuucucucuuaaugucuugccuucugg

SEQ ID NO: 538097 - RNA, 32 nt, Human
uucuuuuucuuagcuuucuuccuucuuuucuc

SEQ ID NO: 538098 - RNA, 32 nt, Human
uucuuuuucuucugugggagaacuuaaugcug

SEQ ID NO: 538099 - RNA, 32 nt, Human
uucuuuuucuucuuguuucucaugaaaaguuu

SEQ ID NO: 538100 - RNA, 32 nt, Human
uucuuuuucuucuuuugagauggagucuugcu

SEQ ID NO: 538101 - RNA, 32 nt, Human
uucuuuuucuuuccuuccuacuugccuucuuu

SEQ ID NO: 538102 - RNA, 32 nt, Human
uucuuuuucuuuccuuccuuccuuuucuuuuc

SEQ ID NO: 538103 - RNA, 32 nt, Human
uucuuuuugaaauucgaggaaaggaggcaugg

SEQ ID NO: 538104 - RNA, 32 nt, Human
uucuuuuugaagaccauuuucuuccauuauug

SEQ ID NO: 538105 - RNA, 22 nt, Human
uucuuuuugagcaaaaaagucg

SEQ ID NO: 538106 - RNA, 32 nt, Human
uucuuuuugcccaggccuggacuuuuugcauc

SEQ ID NO: 538107 - RNA, 32 nt, Human
uucuuuuugcccaggcuggagugcaguggcgc

SEQ ID NO: 538108 - RNA, 32 nt, Human
uucuuuuugccuaggcuggagugcagugguac

SEQ ID NO: 538109 - RNA, 32 nt, Human
uucuuuuugucucccuucccucccucccuccc

SEQ ID NO: 538110 - RNA, 32 nt, Human
uucuuuuugugagcuuacuugccuggauugcu

SEQ ID NO: 538111 - RNA, 27 nt, Human
uucuuuuuucaucucuauuuagcaaca

SEQ ID NO: 538112 - RNA, 32 nt, Human
uugaaaaagauauuuaugauguuaacauuuca

SEQ ID NO: 538113 - RNA, 32 nt, Human
uugaaaaagaucgcgaauaaaaaucaacaaag

SEQ ID NO: 538114 - RNA, 32 nt, Human
uugaaaaauuauucuuuaauguauaaaguaau

SEQ ID NO: 538115 - RNA, 24 nt, Human
uugaaaacaaacaccuaguuuuca

SEQ ID NO: 538116 - RNA, 23 nt, Human
uugaaaacaaagaagacuucuca

SEQ ID NO: 538117 - RNA, 32 nt, Human
uugaaaacagcuuugaaacacaauucaucggu

SEQ ID NO: 538118 - RNA, 32 nt, Human
uugaaaacaggagguggagguugcagugagcc

SEQ ID NO: 538119 - RNA, 21 nt, Human
uugaaaacaucucaguuuuca

SEQ ID NO: 538120 - RNA, 32 nt, Human
uugaaaacccacccagauccuccccguucuga

SEQ ID NO: 538121 - RNA, 32 nt, Human
uugaaaacccccaauuucuugaaauggguguu

SEQ ID NO: 538122 - RNA, 32 nt, Human
uugaaaacggccucgggagacgggagcugcga

SEQ ID NO: 538123 - RNA, 32 nt, Human
uugaaaacucacauccuuucagcagaagguaa

SEQ ID NO: 538124 - RNA, 32 nt, Human
uugaaaacucauguaaauaaaaaucauagggu

SEQ ID NO: 538125 - RNA, 32 nt, Human
uugaaaacucuugcuuucuuuugguguccauu

SEQ ID NO: 538126 - RNA, 23 nt, Human
uugaaaacugcuaacauuuuuaa

SEQ ID NO: 538127 - RNA, 32 nt, Human
uugaaaagaaaauaggcgcuuugucuccuaca

SEQ ID NO: 538128 - RNA, 32 nt, Human
uugaaaagacuauugcuuauuuuuguuuuuaa

SEQ ID NO: 538129 - RNA, 32 nt, Human
uugaaaagagcaauuuugaaaaugcuguguuc

SEQ ID NO: 538130 - RNA, 32 nt, Human
uugaaaagccaucaaaaaguugugauaucaaa

SEQ ID NO: 538131 - RNA, 31 nt, Human
uugaaaagcuuguccaucacucuaguaggga

SEQ ID NO: 538132 - RNA, 32 nt, Human
uugaaaaggaaaugugcuuuaggcaugaguca

SEQ ID NO: 538133 - RNA, 32 nt, Human
uugaaaaggaccuuguagaaccucuuugcaga

SEQ ID NO: 538134 - RNA, 32 nt, Human
uugaaaaggacucuugagcccuccuggaaugg

SEQ ID NO: 538135 - RNA, 32 nt, Human
uugaaaaggaguuucgcucuuguccaggcugg

SEQ ID NO: 538136 - RNA, 32 nt, Human
uugaaaaggguaguuucucugcagaagcucua

SEQ ID NO: 538137 - RNA, 32 nt, Human
uugaaaaguaaacgauaaaauguggauuaaag

SEQ ID NO: 538138 - RNA, 32 nt, Human
uugaaaaguuagaucugugaucucugggguuu

SEQ ID NO: 538139 - RNA, 32 nt, Human
uugaaaauaaauggcccacaggguaaacacug

SEQ ID NO: 538140 - RNA, 32 nt, Human
uugaaaauacaguggacugaaaagcaaauuua

SEQ ID NO: 538141 - RNA, 32 nt, Human
uugaaaauauuuccucuauaucaugccuggag

SEQ ID NO: 538142 - RNA, 32 nt, Human
uugaaaauauuuccuuuaaagacagaguuuga

SEQ ID NO: 538143 - RNA, 32 nt, Human
uugaaaaucacacacaucacaucaccagugcc

SEQ ID NO: 538144 - RNA, 23 nt, Human
uugaaaauccaaaagccaucuca

SEQ ID NO: 538145 - RNA, 32 nt, Human
uugaaaauccccaaggaaacugaagaugauca

SEQ ID NO: 538146 - RNA, 32 nt, Human
uugaaaaugagcagguagaauauacauugaua

SEQ ID NO: 538147 - RNA, 32 nt, Human
uugaaaaugcuuauucuuccucccuuuuauuu

SEQ ID NO: 538148 - RNA, 32 nt, Human
uugaaaaugcuuccaaaaguagacccuguccc

SEQ ID NO: 538149 - RNA, 32 nt, Human
uugaaaauggagugaacaggaggcaaagccac

SEQ ID NO: 538150 - RNA, 32 nt, Human
uugaaaauuaaagcugcaaaagaaauaaagug

SEQ ID NO: 538151 - RNA, 32 nt, Human
uugaaaauucgcccgagcuguuuauguuuuua

SEQ ID NO: 538152 - RNA, 32 nt, Human
uugaaaauucugaggcaggcuguaugucugua

SEQ ID NO: 538153 - RNA, 32 nt, Human
uugaaacaaagcuguuugcugcuuuaugcagg

SEQ ID NO: 538154 - RNA, 32 nt, Human
uugaaacaaaugaccuguucaucuguggccau

SEQ ID NO: 538155 - RNA, 32 nt, Human
uugaaacaaccuccuucucucuuuugaaugga

SEQ ID NO: 538156 - RNA, 32 nt, Human
uugaaacaacuggccccagcuggcgcaucaga

SEQ ID NO: 538157 - RNA, 23 nt, Human
uugaaacaauaaaauccaacaga

SEQ ID NO: 538158 - RNA, 32 nt, Human
uugaaacaaugagaauacucugugcauuucaa

SEQ ID NO: 538159 - RNA, 32 nt, Human
uugaaacaauugccaucuuuguaguuaugccu

SEQ ID NO: 538160 - RNA, 32 nt, Human
uugaaacaauuuaggggaaugaggggcaaaag

SEQ ID NO: 538161 - RNA, 32 nt, Human
uugaaacacauauucaucauacaucaaagcuc

SEQ ID NO: 538162 - RNA, 32 nt, Human
uugaaacacauccuaagcgucuggugcugcag

SEQ ID NO: 538163 - RNA, 32 nt, Human
uugaaacaggagaugaaagacucuccauuuca

SEQ ID NO: 538164 - RNA, 32 nt, Human
uugaaacauccagcaagacaggccagagugug

SEQ ID NO: 538165 - RNA, 32 nt, Human
uugaaacaucuucccugugucccugggggccc

SEQ ID NO: 538166 - RNA, 32 nt, Human
uugaaaccacuacuguauugccuggauacaca

SEQ ID NO: 538167 - RNA, 32 nt, Human
uugaaaccagcauggccaacagaugugagcca

SEQ ID NO: 538168 - RNA, 32 nt, Human
uugaaaccagccuagguaacauagugagaccc

SEQ ID NO: 538169 - RNA, 32 nt, Human
uugaaaccagccuggacuacauggugaaacuc

SEQ ID NO: 538170 - RNA, 32 nt, Human
uugaaaccagccuggccaacauggcgaaaccc

SEQ ID NO: 538171 - RNA, 32 nt, Human
uugaaaccagccuggccaacauggugaaaacc

SEQ ID NO: 538172 - RNA, 32 nt, Human
uugaaaccagccuggccaacauggugaaaccc

SEQ ID NO: 538173 - RNA, 32 nt, Human
uugaaaccagccuggccaacauggugaaauuc

SEQ ID NO: 538174 - RNA, 32 nt, Human
uugaaaccagccuggccaacguggugagaccc

SEQ ID NO: 538175 - RNA, 32 nt, Human
uugaaaccagccugggcaacauggugaaaccu

SEQ ID NO: 538176 - RNA, 32 nt, Human
uugaaaccagcuguuucccaaacucugcuucc

SEQ ID NO: 538177 - RNA, 32 nt, Human
uugaaaccaggaguucaggaccagccuggaaa

SEQ ID NO: 538178 - RNA, 32 nt, Human
uugaaaccaggaguuugagaccagccugagca

SEQ ID NO: 538179 - RNA, 32 nt, Human
uugaaaccauccuggcuaacacagugaaaccc

SEQ ID NO: 538180 - RNA, 32 nt, Human
uugaaacccagaaggcagggguugcagugagc

SEQ ID NO: 538181 - RNA, 32 nt, Human
uugaaacccgggaaguggagguugcagugagc

SEQ ID NO: 538182 - RNA, 32 nt, Human
uugaaacccguguaauggugacccuuugagcg

SEQ ID NO: 538183 - RNA, 32 nt, Human
uugaaaccuaccuaggcaacauggugaaaccu

SEQ ID NO: 538184 - RNA, 32 nt, Human
uugaaaccuuugccuucuguuccagaggagaa

SEQ ID NO: 538185 - RNA, 32 nt, Human
uugaaacgggaggcggagguugcagugagccg

SEQ ID NO: 538186 - RNA, 32 nt, Human
uugaaacuagaacuagugguuuuagagaacuc

SEQ ID NO: 538187 - RNA, 32 nt, Human
uugaaacuagccuggccaacguggcaaaacuc

SEQ ID NO: 538188 - RNA, 32 nt, Human
uugaaacuaggaguucaagaccagccaaggca

SEQ ID NO: 538189 - RNA, 32 nt, Human
uugaaacuagucuggucaacauggugaaaccc

SEQ ID NO: 538190 - RNA, 32 nt, Human
uugaaacugaacaagccaccugccuucccuga

SEQ ID NO: 538191 - RNA, 32 nt, Human
uugaaacugggagguggagguugcagugagcc

SEQ ID NO: 538192 - RNA, 32 nt, Human
uugaaacugguuggggaaugaggugauaagca

SEQ ID NO: 538193 - RNA, 32 nt, Human
uugaaacuguauaaauuguuuaucucuuaaac

SEQ ID NO: 538194 - RNA, 32 nt, Human
uugaaacuucuuucucuaccuuuugcaaaaua

SEQ ID NO: 538195 - RNA, 32 nt, Human
uugaaacuuuccucgccuuccaccuccugcuc

SEQ ID NO: 538196 - RNA, 32 nt, Human
uugaaacuuucugcuuugccuccuuccauggc

SEQ ID NO: 538197 - RNA, 32 nt, Human
uugaaagaagugaaaauaaacagccagagauu

SEQ ID NO: 538198 - RNA, 32 nt, Human
uugaaagaaguugauuccaacucucauggaug

SEQ ID NO: 538199 - RNA, 32 nt, Human
uugaaagacacacacccaggcaaccccugagg

SEQ ID NO: 538200 - RNA, 32 nt, Human
uugaaagacaucuuuucaucaugggacagcaa

SEQ ID NO: 538201 - RNA, 32 nt, Human
uugaaagacgaaaucaaagcccauuaaugauu

SEQ ID NO: 538202 - RNA, 32 nt, Human
uugaaagacuguaggaaacacuucaauguagu

SEQ ID NO: 538203 - RNA, 32 nt, Human
uugaaagagagccaggccgcugagggggaggg

SEQ ID NO: 538204 - RNA, 32 nt, Human
uugaaagagccucuuaaggcagcugggacaga

SEQ ID NO: 538205 - RNA, 32 nt, Human
uugaaagauauggaagacagagcccaggccau

SEQ ID NO: 538206 - RNA, 32 nt, Human
uugaaagaugccugugcucugcuucaggcuga

SEQ ID NO: 538207 - RNA, 32 nt, Human
uugaaagaugcugaagcccgggccauacccca

SEQ ID NO: 538208 - RNA, 31 nt, Human
uugaaagcacuuuuaccacauggagaaauau

SEQ ID NO: 538209 - RNA, 32 nt, Human
uugaaagcagacaagauacagagcagauaucc

SEQ ID NO: 538210 - RNA, 32 nt, Human
uugaaagcagaggcauccuugagcuuuaaagc

SEQ ID NO: 538211 - RNA, 32 nt, Human
uugaaagccacagaguuaagugaccucaggua

SEQ ID NO: 538212 - RNA, 24 nt, Human
uugaaagccccagaugacagaaag

SEQ ID NO: 538213 - RNA, 22 nt, Human
uugaaagccuacuuucugaaga

SEQ ID NO: 538214 - RNA, 32 nt, Human
uugaaagccuuauucugaauguaagcaaagua

SEQ ID NO: 538215 - RNA, 32 nt, Human
uugaaagcuucaaaguuuauaugccuggugca

SEQ ID NO: 538216 - RNA, 32 nt, Human
uugaaaggaaacuagggagggagggagaggga

SEQ ID NO: 538217 - RNA, 32 nt, Human
uugaaaggaaucaugucuucagccuggaagac

SEQ ID NO: 538218 - RNA, 32 nt, Human
uugaaaggacugcccuuugcucuaucaccuuu

SEQ ID NO: 538219 - RNA, 32 nt, Human
uugaaaggcaaaaacuuccaucacaacaagaa

SEQ ID NO: 538220 - RNA, 32 nt, Human
uugaaaggccagaggguggccuuuuuccccaa

SEQ ID NO: 538221 - RNA, 32 nt, Human
uugaaaggccaucagauuagcagggacggggu

SEQ ID NO: 538222 - RNA, 32 nt, Human
uugaaaggcccaggcucguugccaggcaccau

SEQ ID NO: 538223 - RNA, 32 nt, Human
uugaaaggcugaggcaacaggaucauuugagc

SEQ ID NO: 538224 - RNA, 32 nt, Human
uugaaaggcugaggcaggagaaucgcuugaac

SEQ ID NO: 538225 - RNA, 32 nt, Human
uugaaagggaccaaguagcucacuacgauauc

SEQ ID NO: 538226 - RNA, 32 nt, Human
uugaaagggcaggcagguggugagagccagag

SEQ ID NO: 538227 - RNA, 32 nt, Human
uugaaagggggaaauaggaagagcagauugcu

SEQ ID NO: 538228 - RNA, 21 nt, Human
uugaaaguagaucgaacagaa

SEQ ID NO: 538229 - RNA, 32 nt, Human
uugaaagucuaagagaauaugcaagcuaccca

SEQ ID NO: 538230 - RNA, 32 nt, Human
uugaaagucuguccuugaaggacuaauagaaa

SEQ ID NO: 538231 - RNA, 23 nt, Human
uugaaagucuuaaaggagacacu

SEQ ID NO: 538232 - RNA, 21 nt, Human
uugaaagucuuguaacagaaa

SEQ ID NO: 538233 - RNA, 21 nt, Human
uugaaagugaagaagagaaag

SEQ ID NO: 538234 - RNA, 32 nt, Human
uugaaagugagugguguccuuuggaggcaugg

SEQ ID NO: 538235 - RNA, 32 nt, Human
uugaaaguggcaaaauggagguuucacaggcu

SEQ ID NO: 538236 - RNA, 32 nt, Human
uugaaaguugccuuuucucuccacccuugagu

SEQ ID NO: 538237 - RNA, 32 nt, Human
uugaaaguuggaaacuaucccauugcaaguuu

SEQ ID NO: 538238 - RNA, 16 nt, Human
uugaaaguuucugaga

SEQ ID NO: 538239 - RNA, 22 nt, Human
uugaaaguuuguucugcagaga

SEQ ID NO: 538240 - RNA, 32 nt, Human
uugaaauaaccagccucugaaggagccaaugg

SEQ ID NO: 538241 - RNA, 32 nt, Human
uugaaauaccaccucucaggugaagaaccguc

SEQ ID NO: 538242 - RNA, 32 nt, Human
uugaaauacuugcuggcacugcaccuggauuu

SEQ ID NO: 538243 - RNA, 32 nt, Human
uugaaauagauuucauuucuugugcacacagc

SEQ ID NO: 538244 - RNA, 32 nt, Human
uugaaauauauguauguauucauggauaugua

SEQ ID NO: 538245 - RNA, 32 nt, Human
uugaaaucauuuacuguaagugcaaugaugca

SEQ ID NO: 538246 - RNA, 32 nt, Human
uugaaauccugcugguaguguaugacaacguc

SEQ ID NO: 538247 - RNA, 32 nt, Human
uugaaauccuggaacagcuggcucagacauuu

SEQ ID NO: 538248 - RNA, 32 nt, Human
uugaaaucuguucaaaaacagauuaagacaaa

SEQ ID NO: 538249 - RNA, 32 nt, Human
uugaaaugaaaccacaggcagcccagcccucc

SEQ ID NO: 538250 - RNA, 32 nt, Human
uugaaaugcaagaaauaacaaugauggcagca

SEQ ID NO: 538251 - RNA, 32 nt, Human
uugaaaugccuaaaagacuuuauuguucuaau

SEQ ID NO: 538252 - RNA, 32 nt, Human
uugaaaugccuuucaaccauuuccuucugugg

SEQ ID NO: 538253 - RNA, 32 nt, Human
uugaaaugcgaaaaauuagauugaggcuuugc

SEQ ID NO: 538254 - RNA, 32 nt, Human
uugaaaugcuccauaacaaaauugaaaaacug

SEQ ID NO: 538255 - RNA, 32 nt, Human
uugaaauggaauuggcaaugugggaaauaaga

SEQ ID NO: 538256 - RNA, 32 nt, Human
uugaaauggacucugagauggcagcguggugc

SEQ ID NO: 538257 - RNA, 32 nt, Human
uugaaauggagaggagguaggagggugagguc

SEQ ID NO: 538258 - RNA, 32 nt, Human
uugaaauggaguuuugcucuuguugcccaggc

SEQ ID NO: 538259 - RNA, 32 nt, Human
uugaaauggucauugaggaagcaacuacagau

SEQ ID NO: 538260 - RNA, 32 nt, Human
uugaaaugugccaaauuuucuuaccucaucuc

SEQ ID NO: 538261 - RNA, 32 nt, Human
uugaaauguggugagagaggaauugaauugaa

SEQ ID NO: 538262 - RNA, 32 nt, Human
uugaaaugugugacucugcugagugacguagg

SEQ ID NO: 538263 - RNA, 32 nt, Human
uugaaauguguguggaggcuuacacauagaga

SEQ ID NO: 538264 - RNA, 32 nt, Human
uugaaauuaaauauccuuaaccaaugauuaaa

SEQ ID NO: 538265 - RNA, 32 nt, Human
uugaaauuaccuccauucuuacuuuguuagca

SEQ ID NO: 538266 - RNA, 32 nt, Human
uugaaauuauucacuuauuuuccaaguauuua

SEQ ID NO: 538267 - RNA, 32 nt, Human
uugaaauucagccuuaaauuaagcucuuaguu

SEQ ID NO: 538268 - RNA, 32 nt, Human
uugaaauucccagaagagagcuguuuuguaau

SEQ ID NO: 538269 - RNA, 32 nt, Human
uugaaauucuguuuacacuugucagaaauaag

SEQ ID NO: 538270 - RNA, 32 nt, Human
uugaaauugccuggggucuaugaagucuuauu

SEQ ID NO: 538271 - RNA, 32 nt, Human
uugaaauuucuaagggcauucuagaccucugu

SEQ ID NO: 538272 - RNA, 32 nt, Human
uugaaauuuggggaggcaucucugauuuaaaa

SEQ ID NO: 538273 - RNA, 32 nt, Human
uugaaauuuguagguacuaucugucuuauuuu

SEQ ID NO: 538274 - RNA, 22 nt, Human
uugaacaaacauucuuaacucc

SEQ ID NO: 538275 - RNA, 32 nt, Human
uugaacaagccacguugcagaaaaagagcuuc

SEQ ID NO: 538276 - RNA, 32 nt, Human
uugaacaaggaagaggagaaaagggaauuuug

SEQ ID NO: 538277 - RNA, 32 nt, Human
uugaacaauguacucccuggccuggauacauu

SEQ ID NO: 538278 - RNA, 32 nt, Human
uugaacacagaagguggagguugcagugagcc

SEQ ID NO: 538279 - RNA, 32 nt, Human
uugaacacaggcaaagaggugcugcuuugcuu

SEQ ID NO: 538280 - RNA, 24 nt, Human
uugaacacaguauuuucccaauag

SEQ ID NO: 538281 - RNA, 32 nt, Human
uugaacaccaggaaugacuggaacccuggaga

SEQ ID NO: 538282 - RNA, 32 nt, Human
uugaacagcggcuggagcagguugagaguggc

SEQ ID NO: 538283 - RNA, 32 nt, Human
uugaacagggaagcagagguugcggugaaccg

SEQ ID NO: 538284 - RNA, 32 nt, Human
uugaacagggaggcagagguugcagugagccg

SEQ ID NO: 538285 - RNA, 32 nt, Human
uugaacagggugagacaguccacccagagcuc

SEQ ID NO: 538286 - RNA, 32 nt, Human
uugaacaguagaccuaaaaggguuuuaagcua

SEQ ID NO: 538287 - RNA, 32 nt, Human
uugaacaguccagcaauagcaauccagaauug

SEQ ID NO: 538288 - RNA, 32 nt, Human
uugaacaguccugggcacugcugguaaauuaa

SEQ ID NO: 538289 - RNA, 32 nt, Human
uugaacagugaucuuugcucucugccuggcuc

SEQ ID NO: 538290 - RNA, 32 nt, Human
uugaacauauagauauguaacaugccacaaau

SEQ ID NO: 538291 - RNA, 32 nt, Human
uugaacauccugcagucacagggucagggguc

SEQ ID NO: 538292 - RNA, 18 nt, Human
uugaacauguaugauuuc

SEQ ID NO: 538293 - RNA, 32 nt, Human
uugaacauucaggccuugcuggguucccugcu

SEQ ID NO: 538294 - RNA, 32 nt, Human
uugaaccaacccaaauguccaacaaugauaga

SEQ ID NO: 538295 - RNA, 32 nt, Human
uugaaccaacugucuucuggaucuauuggaua

SEQ ID NO: 538296 - RNA, 32 nt, Human
uugaaccaaggagguggagguugcagugagcc

SEQ ID NO: 538297 - RNA, 32 nt, Human
uugaaccacaucugcaccugugagaggccagu

SEQ ID NO: 538298 - RNA, 32 nt, Human
uugaaccaggaauauccaggaagaggaaauuc

SEQ ID NO: 538299 - RNA, 32 nt, Human
uugaaccaggagacggagguugcagugagcug

SEQ ID NO: 538300 - RNA, 32 nt, Human
uugaaccaggagacggagguuucagugaauga

SEQ ID NO: 538301 - RNA, 32 nt, Human
uugaaccaggagguggacguugcagugauccc

SEQ ID NO: 538302 - RNA, 32 nt, Human
uugaaccaggauggggagguugcagugagccg

SEQ ID NO: 538303 - RNA, 32 nt, Human
uugaaccagggaggcagaggcugcggugagcc

SEQ ID NO: 538304 - RNA, 32 nt, Human
uugaaccagggagguggagguugcagugagcc

SEQ ID NO: 538305 - RNA, 32 nt, Human
uugaaccagggagguggagguugcagugagcu

SEQ ID NO: 538306 - RNA, 32 nt, Human
uugaaccaguagugaaagcauuucucaacaau

SEQ ID NO: 538307 - RNA, 32 nt, Human
uugaaccagugaaauaugauguauuucugagc

SEQ ID NO: 538308 - RNA, 32 nt, Human
uugaaccaucucugccccaugcucaagaccug

SEQ ID NO: 538309 - RNA, 32 nt, Human
uugaacccaaaccagaguacucuuacugccuc

SEQ ID NO: 538310 - RNA, 32 nt, Human
uugaacccaagaggcggagguugcagugagcc

SEQ ID NO: 538311 - RNA, 32 nt, Human
uugaacccaagaggcggagguuguggugagcc

SEQ ID NO: 538312 - RNA, 32 nt, Human
uugaacccaagaggucgaggcugcagugagcc

SEQ ID NO: 538313 - RNA, 32 nt, Human
uugaacccaagagguggaggcugaagugagcc

SEQ ID NO: 538314 - RNA, 32 nt, Human
uugaacccaagagguggagguugcggugagcc

SEQ ID NO: 538315 - RNA, 32 nt, Human
uugaacccagaagacagguugcagugagccaa

SEQ ID NO: 538316 - RNA, 32 nt, Human
uugaacccagaaggcggaaguugcagugagcc

SEQ ID NO: 538317 - RNA, 32 nt, Human
uugaacccagaaggcggaaguugcagugagcu

SEQ ID NO: 538318 - RNA, 32 nt, Human
uugaacccagaaggugcagguugcagugagcu

SEQ ID NO: 538319 - RNA, 32 nt, Human
uugaacccagcagauggagguugcagugagcc

SEQ ID NO: 538320 - RNA, 32 nt, Human
uugaacccaggaagcggagguugcagugagcc

SEQ ID NO: 538321 - RNA, 32 nt, Human
uugaacccaggaagcgggguugcagugagcca

SEQ ID NO: 538322 - RNA, 32 nt, Human
uugaacccaggaaguagagguugcagugagcc

SEQ ID NO: 538323 - RNA, 32 nt, Human
uugaacccaggaaguggagguugcagugagcc

SEQ ID NO: 538324 - RNA, 32 nt, Human
uugaacccaggaaguggagguugcagugagcu

SEQ ID NO: 538325 - RNA, 32 nt, Human
uugaacccaggaaguggcaguugcagugagcc

SEQ ID NO: 538326 - RNA, 32 nt, Human
uugaacccaggagacagagguugcagugagcc

SEQ ID NO: 538327 - RNA, 32 nt, Human
uugaacccaggagacagagguuguagugagcu

SEQ ID NO: 538328 - RNA, 32 nt, Human
uugaacccaggagacagagguugugguggggc

SEQ ID NO: 538329 - RNA, 32 nt, Human
uugaacccaggagacagggguugcagugagcc

SEQ ID NO: 538330 - RNA, 32 nt, Human
uugaacccaggagacauggguugcagugagcc

SEQ ID NO: 538331 - RNA, 32 nt, Human
uugaacccaggagacgagguugcagugagccg

SEQ ID NO: 538332 - RNA, 32 nt, Human
uugaacccaggagacggaaguugcagugagcu

SEQ ID NO: 538333 - RNA, 32 nt, Human
uugaacccaggagacggagguugcagugagcc

SEQ ID NO: 538334 - RNA, 32 nt, Human
uugaacccaggagacggagguugcggugaguu

SEQ ID NO: 538335 - RNA, 32 nt, Human
uugaacccaggagacggugguugcagugagcc

SEQ ID NO: 538336 - RNA, 32 nt, Human
uugaacccaggagacggugguugcagugagcg

SEQ ID NO: 538337 - RNA, 32 nt, Human
uugaacccaggagaggaagguugcaguaagcu

SEQ ID NO: 538338 - RNA, 32 nt, Human
uugaacccaggagauagagguugcaaugagcc

SEQ ID NO: 538339 - RNA, 32 nt, Human
uugaacccaggagauggaaguugcagugagcu

SEQ ID NO: 538340 - RNA, 32 nt, Human
uugaacccaggagauggagauugcaguaggcc

SEQ ID NO: 538341 - RNA, 32 nt, Human
uugaacccaggagauggagguugcagugagcc

SEQ ID NO: 538342 - RNA, 32 nt, Human
uugaacccaggagauggagguugcagugagcu

SEQ ID NO: 538343 - RNA, 32 nt, Human
uugaacccaggagauggagguugcggugagcu

SEQ ID NO: 538344 - RNA, 32 nt, Human
uugaacccaggagauugagguuguagugagcu

SEQ ID NO: 538345 - RNA, 32 nt, Human
uugaacccaggaggaagagguugcagugagcc

SEQ ID NO: 538346 - RNA, 32 nt, Human
uugaacccaggaggcacagauugcagugagcc

SEQ ID NO: 538347 - RNA, 32 nt, Human
uugaacccaggaggcacagguugcagugagcc

SEQ ID NO: 538348 - RNA, 32 nt, Human
uugaacccaggaggcagaaguugcagugagca

SEQ ID NO: 538349 - RNA, 32 nt, Human
uugaacccaggaggcagaaguugcagugagcc

SEQ ID NO: 538350 - RNA, 32 nt, Human
uugaacccaggaggcagaaguugcagugagcu

SEQ ID NO: 538351 - RNA, 32 nt, Human
uugaacccaggaggcagagaucgcagugaguu

SEQ ID NO: 538352 - RNA, 32 nt, Human
uugaacccaggaggcagagauugcagugagcc

SEQ ID NO: 538353 - RNA, 32 nt, Human
uugaacccaggaggcagagauugcagugagcu

SEQ ID NO: 538354 - RNA, 32 nt, Human
uugaacccaggaggcagagauugcggugagcc

SEQ ID NO: 538355 - RNA, 32 nt, Human
uugaacccaggaggcagaggguugcagugagc

SEQ ID NO: 538356 - RNA, 32 nt, Human
uugaacccaggaggcagagguuacaguaaacc

SEQ ID NO: 538357 - RNA, 32 nt, Human
uugaacccaggaggcagagguuacagugagca

SEQ ID NO: 538358 - RNA, 32 nt, Human
uugaacccaggaggcagagguugcaaugagcc

SEQ ID NO: 538359 - RNA, 32 nt, Human
uugaacccaggaggcagagguugcagcgagcu

SEQ ID NO: 538360 - RNA, 32 nt, Human
uugaacccaggaggcagagguugcaguaagcc

SEQ ID NO: 538361 - RNA, 32 nt, Human
uugaacccaggaggcagagguugcagucagcc

SEQ ID NO: 538362 - RNA, 32 nt, Human
uugaacccaggaggcagagguugcagugagcc

SEQ ID NO: 538363 - RNA, 32 nt, Human
uugaacccaggaggcagagguugcagugagcu

SEQ ID NO: 538364 - RNA, 32 nt, Human
uugaacccaggaggcagagguugcagugaguc

SEQ ID NO: 538365 - RNA, 32 nt, Human
uugaacccaggaggcagagguugcagugcacc

SEQ ID NO: 538366 - RNA, 32 nt, Human
uugaacccaggaggcagagguugcagugcgcu

SEQ ID NO: 538367 - RNA, 32 nt, Human
uugaacccaggaggcagagguugcagugggcc

SEQ ID NO: 538368 - RNA, 32 nt, Human
uugaacccaggaggcagagguugcggugagcc

SEQ ID NO: 538369 - RNA, 32 nt, Human
uugaacccaggaggcagagguuggggugagcu

SEQ ID NO: 538370 - RNA, 32 nt, Human
uugaacccaggaggcagagguuguagugagcc

SEQ ID NO: 538371 - RNA, 32 nt, Human
uugaacccaggaggcagaguuugcagucagcc

SEQ ID NO: 538372 - RNA, 32 nt, Human
uugaacccaggaggcagaguuugcagugagcc

SEQ ID NO: 538373 - RNA, 32 nt, Human
uugaacccaggaggcagaguuugcagugagcu

SEQ ID NO: 538374 - RNA, 32 nt, Human
uugaacccaggaggcagcuguugcagugagcc

SEQ ID NO: 538375 - RNA, 32 nt, Human
uugaacccaggaggcagugauugcagugagcu

SEQ ID NO: 538376 - RNA, 32 nt, Human
uugaacccaggaggcagugguugcaaugagcc

SEQ ID NO: 538377 - RNA, 32 nt, Human
uugaacccaggaggccgagguugcagugagcc

SEQ ID NO: 538378 - RNA, 32 nt, Human
uugaacccaggaggcgaagguugcaguaaacc

SEQ ID NO: 538379 - RNA, 32 nt, Human
uugaacccaggaggcggaaguugcagugagcu

SEQ ID NO: 538380 - RNA, 32 nt, Human
uugaacccaggaggcggagauugcagugagcc

SEQ ID NO: 538381 - RNA, 32 nt, Human
uugaacccaggaggcggagauugcagugagcu

SEQ ID NO: 538382 - RNA, 32 nt, Human
uugaacccaggaggcggagcuugcagugagcc

SEQ ID NO: 538383 - RNA, 32 nt, Human
uugaacccaggaggcggaggcugcagugagcc

SEQ ID NO: 538384 - RNA, 32 nt, Human
uugaacccaggaggcggaggcugcagugagcu

SEQ ID NO: 538385 - RNA, 32 nt, Human
uugaacccaggaggcggagguagcagugagcc

SEQ ID NO: 538386 - RNA, 32 nt, Human
uugaacccaggaggcggagguuacagugagcc

SEQ ID NO: 538387 - RNA, 32 nt, Human
uugaacccaggaggcggagguugcaguaagcc

SEQ ID NO: 538388 - RNA, 32 nt, Human
uugaacccaggaggcggagguugcagugaacc

SEQ ID NO: 538389 - RNA, 32 nt, Human
uugaacccaggaggcggagguugcagugaccc

SEQ ID NO: 538390 - RNA, 32 nt, Human
uugaacccaggaggcggagguugcagugagac

SEQ ID NO: 538391 - RNA, 32 nt, Human
uugaacccaggaggcggagguugcagugagca

SEQ ID NO: 538392 - RNA, 32 nt, Human
uugaacccaggaggcggagguugcagugagcc

SEQ ID NO: 538393 - RNA, 32 nt, Human
uugaacccaggaggcggagguugcagugagcu

SEQ ID NO: 538394 - RNA, 32 nt, Human
uugaacccaggaggcggagguugcagugaucc

SEQ ID NO: 538395 - RNA, 32 nt, Human
uugaacccaggaggcggagguugcggugagcc

SEQ ID NO: 538396 - RNA, 32 nt, Human
uugaacccaggaggcggagguugcggugagcu

SEQ ID NO: 538397 - RNA, 32 nt, Human
uugaacccaggaggcggagguugcggugaguu

SEQ ID NO: 538398 - RNA, 32 nt, Human
uugaacccaggaggcggagguuguagugagcc

SEQ ID NO: 538399 - RNA, 32 nt, Human
uugaacccaggaggcggagguuguauaggcug

SEQ ID NO: 538400 - RNA, 32 nt, Human
uugaacccaggaggcggagguuguggugagcc

SEQ ID NO: 538401 - RNA, 32 nt, Human
uugaacccaggaggcggaguuugcagugagcu

SEQ ID NO: 538402 - RNA, 32 nt, Human
uugaacccaggaggcggggguugcagugaguc

SEQ ID NO: 538403 - RNA, 32 nt, Human
uugaacccaggaggcugagguugcagugagcc

SEQ ID NO: 538404 - RNA, 32 nt, Human
uugaacccaggagguagaagcugcagugagca

SEQ ID NO: 538405 - RNA, 32 nt, Human
uugaacccaggagguagaaguugcagugagcc

SEQ ID NO: 538406 - RNA, 32 nt, Human
uugaacccaggagguagaggcugcagugagca

SEQ ID NO: 538407 - RNA, 32 nt, Human
uugaacccaggagguagaggcugcagugagcc

SEQ ID NO: 538408 - RNA, 32 nt, Human
uugaacccaggagguagaggcugcagugagcu

SEQ ID NO: 538409 - RNA, 32 nt, Human
uugaacccaggagguagagguugcagugagcc

SEQ ID NO: 538410 - RNA, 32 nt, Human
uugaacccaggaggugaagguugcagugaccg

SEQ ID NO: 538411 - RNA, 32 nt, Human
uugaacccaggaggugcagguugcagugagcc

SEQ ID NO: 538412 - RNA, 32 nt, Human
uugaacccaggagguggagauugcagugagcu

SEQ ID NO: 538413 - RNA, 32 nt, Human
uugaacccaggagguggaggaugcagugaacu

SEQ ID NO: 538414 - RNA, 32 nt, Human
uugaacccaggagguggaggcugcagugagcu

SEQ ID NO: 538415 - RNA, 32 nt, Human
uugaacccaggagguggaggcugcggugagcc

SEQ ID NO: 538416 - RNA, 32 nt, Human
uugaacccaggagguggagguagcagugagcc

SEQ ID NO: 538417 - RNA, 32 nt, Human
uugaacccaggagguggagguuacagugagcc

SEQ ID NO: 538418 - RNA, 32 nt, Human
uugaacccaggagguggagguuacagugagcu

SEQ ID NO: 538419 - RNA, 32 nt, Human
uugaacccaggagguggagguuccagugagcc

SEQ ID NO: 538420 - RNA, 32 nt, Human
uugaacccaggagguggagguugcaagugagc

SEQ ID NO: 538421 - RNA, 32 nt, Human
uugaacccaggagguggagguugcagcaagca

SEQ ID NO: 538422 - RNA, 32 nt, Human
uugaacccaggagguggagguugcaguaagcc

SEQ ID NO: 538423 - RNA, 32 nt, Human
uugaacccaggagguggagguugcaguaagcu

SEQ ID NO: 538424 - RNA, 32 nt, Human
uugaacccaggagguggagguugcagugaacu

SEQ ID NO: 538425 - RNA, 32 nt, Human
uugaacccaggagguggagguugcagugagca

SEQ ID NO: 538426 - RNA, 32 nt, Human
uugaacccaggagguggagguugcagugagcc

SEQ ID NO: 538427 - RNA, 32 nt, Human
uugaacccaggagguggagguugcagugagcu

SEQ ID NO: 538428 - RNA, 32 nt, Human
uugaacccaggagguggagguugcagugaggc

SEQ ID NO: 538429 - RNA, 32 nt, Human
uugaacccaggagguggagguugcagugaguc

SEQ ID NO: 538430 - RNA, 32 nt, Human
uugaacccaggagguggagguugcagugggcc

SEQ ID NO: 538431 - RNA, 32 nt, Human
uugaacccaggagguggagguugcaguuagcu

SEQ ID NO: 538432 - RNA, 32 nt, Human
uugaacccaggagguggagguugcggugagcu

SEQ ID NO: 538433 - RNA, 32 nt, Human
uugaacccaggagguggagguuguagugagac

SEQ ID NO: 538434 - RNA, 32 nt, Human
uugaacccaggagguggagguuguggugagcc

SEQ ID NO: 538435 - RNA, 32 nt, Human
uugaacccaggagguggagguuguggugagcu

SEQ ID NO: 538436 - RNA, 32 nt, Human
uugaacccaggagguggaguuugcagugagcu

SEQ ID NO: 538437 - RNA, 32 nt, Human
uugaacccaggaggugggcauugcagugagcc

SEQ ID NO: 538438 - RNA, 32 nt, Human
uugaacccaggagguggugguugcagugagcc

SEQ ID NO: 538439 - RNA, 32 nt, Human
uugaacccaggagguugaggcugcagugaguc

SEQ ID NO: 538440 - RNA, 32 nt, Human
uugaacccaggagucagagguuucagugagcc

SEQ ID NO: 538441 - RNA, 32 nt, Human
uugaacccaggagucggagguugcagugaguu

SEQ ID NO: 538442 - RNA, 32 nt, Human
uugaacccaggaguucaaaucugcagugcgca

SEQ ID NO: 538443 - RNA, 32 nt, Human
uugaacccaggaguucaagaccagccuggaca

SEQ ID NO: 538444 - RNA, 32 nt, Human
uugaacccaggaguucaagaccagccugggca

SEQ ID NO: 538445 - RNA, 32 nt, Human
uugaacccaggaguucaagucugcagugagcu

SEQ ID NO: 538446 - RNA, 32 nt, Human
uugaacccaggaguucgagaccagccugggca

SEQ ID NO: 538447 - RNA, 32 nt, Human
uugaacccaggcaguggagguugcagugagcc

SEQ ID NO: 538448 - RNA, 32 nt, Human
uugaacccaggcaguggugggaugggagggca

SEQ ID NO: 538449 - RNA, 32 nt, Human
uugaacccaggccaugugguuagacguuggug

SEQ ID NO: 538450 - RNA, 32 nt, Human
uugaacccagggggcagagguugcagugagcc

SEQ ID NO: 538451 - RNA, 32 nt, Human
uugaacccaguaggcggaaguugcagugagcu

SEQ ID NO: 538452 - RNA, 32 nt, Human
uugaacccaguggcggaggcugcagugagccg

SEQ ID NO: 538453 - RNA, 32 nt, Human
uugaacccaugaggcggagguugcagugagcc

SEQ ID NO: 538454 - RNA, 32 nt, Human
uugaacccccgccauccuucaccagagcccau

SEQ ID NO: 538455 - RNA, 32 nt, Human
uugaaccccggagauggagguugcagugagcc

SEQ ID NO: 538456 - RNA, 32 nt, Human
uugaaccccggaggcggagguugcagugagcu

SEQ ID NO: 538457 - RNA, 32 nt, Human
uugaaccccggagguagagguugcagugagcc

SEQ ID NO: 538458 - RNA, 32 nt, Human
uugaacccgagaggcggaaguugcagugagcc

SEQ ID NO: 538459 - RNA, 32 nt, Human
uugaacccgagagguggagguugcagugaacc

SEQ ID NO: 538460 - RNA, 32 nt, Human
uugaacccgagagguggagguugcagugagcc

SEQ ID NO: 538461 - RNA, 32 nt, Human
uugaacccgcuuccaccuccgucucccucuuc

SEQ ID NO: 538462 - RNA, 32 nt, Human
uugaacccggaagcgaagguugcagugagcca

SEQ ID NO: 538463 - RNA, 32 nt, Human
uugaacccggaggcagagguugcagugagccg

SEQ ID NO: 538464 - RNA, 32 nt, Human
uugaacccggaggcggagguugcgguaagccg

SEQ ID NO: 538465 - RNA, 32 nt, Human
uugaacccgggagacgggagguuguggugagc

SEQ ID NO: 538466 - RNA, 32 nt, Human
uugaacccgggagaugaagguugcagugagcu

SEQ ID NO: 538467 - RNA, 32 nt, Human
uugaacccgggaggcaaagguugcagugagcu

SEQ ID NO: 538468 - RNA, 32 nt, Human
uugaacccgggaggcagaaguugcagugaacu

SEQ ID NO: 538469 - RNA, 32 nt, Human
uugaacccgggaggcagaggcugcagugagcc

SEQ ID NO: 538470 - RNA, 32 nt, Human
uugaacccgggaggcagagguugcaguaagca

SEQ ID NO: 538471 - RNA, 32 nt, Human
uugaacccgggaggcagagguugcagugagcc

SEQ ID NO: 538472 - RNA, 32 nt, Human
uugaacccgggaggcagagguugcagugagcu

SEQ ID NO: 538473 - RNA, 32 nt, Human
uugaacccgggaggcagagguugcagugaggu

SEQ ID NO: 538474 - RNA, 32 nt, Human
uugaacccgggaggcagagguugcagugaguc

SEQ ID NO: 538475 - RNA, 32 nt, Human
uugaacccgggaggcagagguugcagugagug

SEQ ID NO: 538476 - RNA, 32 nt, Human
uugaacccgggaggcagagguugcaguguggu

SEQ ID NO: 538477 - RNA, 32 nt, Human
uugaacccgggaggcagcaguugcagugagcu

SEQ ID NO: 538478 - RNA, 32 nt, Human
uugaacccgggaggcggaggcugcagugagcc

SEQ ID NO: 538479 - RNA, 32 nt, Human
uugaacccgggaggcggaggcugcagugaguc

SEQ ID NO: 538480 - RNA, 32 nt, Human
uugaacccgggaggcggagguugcaguaagcc

SEQ ID NO: 538481 - RNA, 32 nt, Human
uugaacccgggaggcggagguugcagugagcc

SEQ ID NO: 538482 - RNA, 32 nt, Human
uugaacccgggaggcggagguugcagugagcu

SEQ ID NO: 538483 - RNA, 32 nt, Human
uugaacccgggaggcggagguugcagugaggu

SEQ ID NO: 538484 - RNA, 32 nt, Human
uugaacccgggaggcggagguugcagugaguc

SEQ ID NO: 538485 - RNA, 32 nt, Human
uugaacccgggaggcggagguugcaguuagcc

SEQ ID NO: 538486 - RNA, 32 nt, Human
uugaacccgggagggagagguugcagugagcc

SEQ ID NO: 538487 - RNA, 32 nt, Human
uugaacccgggagguagaggcugcaaugggcc

SEQ ID NO: 538488 - RNA, 32 nt, Human
uugaacccgggagguagagguugcagugagcc

SEQ ID NO: 538489 - RNA, 32 nt, Human
uugaacccgggagguggaggcugcaaugagcu

SEQ ID NO: 538490 - RNA, 32 nt, Human
uugaacccgggagguggaggcugcagcgagcc

SEQ ID NO: 538491 - RNA, 32 nt, Human
uugaacccgggagguggaggcugcagugagcc

SEQ ID NO: 538492 - RNA, 32 nt, Human
uugaacccgggagguggaggcugcagugaguu

SEQ ID NO: 538493 - RNA, 32 nt, Human
uugaacccgggagguggaggcugcggugagcc

SEQ ID NO: 538494 - RNA, 32 nt, Human
uugaacccgggagguggagguugcaguaagcc

SEQ ID NO: 538495 - RNA, 32 nt, Human
uugaacccgggagguggagguugcagugaacc

SEQ ID NO: 538496 - RNA, 32 nt, Human
uugaacccgggagguggagguugcagugagcc

SEQ ID NO: 538497 - RNA, 32 nt, Human
uugaacccgggagguggagguugcagugagcu

SEQ ID NO: 538498 - RNA, 32 nt, Human
uugaacccgggagguggagguugcagugaggu

SEQ ID NO: 538499 - RNA, 32 nt, Human
uugaacccgggagguguagguugcagugagcc

SEQ ID NO: 538500 - RNA, 32 nt, Human
uugaacccgggaguuaaagguugcagugagcc

SEQ ID NO: 538501 - RNA, 32 nt, Human
uugaacccgggaguuggagguugcagugagcc

SEQ ID NO: 538502 - RNA, 32 nt, Human
uugaacccgggcggcggaaguugcagugagcc

SEQ ID NO: 538503 - RNA, 32 nt, Human
uugaacccggggacggagguugcagugaaccg

SEQ ID NO: 538504 - RNA, 32 nt, Human
uugaacccgggggcagaggcugcagugagccg

SEQ ID NO: 538505 - RNA, 32 nt, Human
uugaacccuccagguggugccgggcuggggcu

SEQ ID NO: 538506 - RNA, 32 nt, Human
uugaacccugcucuauccccugcccucuucca

SEQ ID NO: 538507 - RNA, 32 nt, Human
uugaacccuggaaguggagguugcagugagcc

SEQ ID NO: 538508 - RNA, 32 nt, Human
uugaacccuggaggcggaaguugcagugagcc

SEQ ID NO: 538509 - RNA, 32 nt, Human
uugaacccuggaggcggagguugcagugagcc

SEQ ID NO: 538510 - RNA, 32 nt, Human
uugaacccuggaggcggagguugcagugagug

SEQ ID NO: 538511 - RNA, 32 nt, Human
uugaacccuggagguagaaguugcagugagcc

SEQ ID NO: 538512 - RNA, 32 nt, Human
uugaacccuggagguggagguugcagugagcc

SEQ ID NO: 538513 - RNA, 32 nt, Human
uugaacccuggagguggagguugcagugagcu

SEQ ID NO: 538514 - RNA, 32 nt, Human
uugaacccugggagcggagauugcagugagcu

SEQ ID NO: 538515 - RNA, 32 nt, Human
uugaacccugggaggcagagguugcagugagu

SEQ ID NO: 538516 - RNA, 32 nt, Human
uugaacccuguaauugucacacaucucuggua

SEQ ID NO: 538517 - RNA, 32 nt, Human
uugaacccuugagcucaggaguuuggaccagc

SEQ ID NO: 538518 - RNA, 32 nt, Human
uugaaccgggaggcagaaguugcagugagccg

SEQ ID NO: 538519 - RNA, 32 nt, Human
uugaaccgggaggcggagguugcagugagccg

SEQ ID NO: 538520 - RNA, 32 nt, Human
uugaaccggggagguggaggcugcagugagcc

SEQ ID NO: 538521 - RNA, 32 nt, Human
uugaaccggggagguggagguugcagugagcu

SEQ ID NO: 538522 - RNA, 32 nt, Human
uugaaccuagaagguggagguugcagugagcg

SEQ ID NO: 538523 - RNA, 32 nt, Human
uugaaccuagaaugagacugcagcagccccag

SEQ ID NO: 538524 - RNA, 32 nt, Human
uugaaccuaggaggcagaaguugcagugagca

SEQ ID NO: 538525 - RNA, 32 nt, Human
uugaaccuaggaggcagagguugcagugaacc

SEQ ID NO: 538526 - RNA, 32 nt, Human
uugaaccuaggaggcagagguugcagugagcc

SEQ ID NO: 538527 - RNA, 32 nt, Human
uugaaccuaggaggcggagguugcagugagcc

SEQ ID NO: 538528 - RNA, 32 nt, Human
uugaaccuaggaggcggagguugcagugaguc

SEQ ID NO: 538529 - RNA, 32 nt, Human
uugaaccuaggaggggaagguugcagugagcc

SEQ ID NO: 538530 - RNA, 32 nt, Human
uugaaccuaggaggucgaggcugcagugagcc

SEQ ID NO: 538531 - RNA, 32 nt, Human
uugaaccuaggagguggagguugcagugagcc

SEQ ID NO: 538532 - RNA, 32 nt, Human
uugaaccuaggagguggagguugcagugagcu

SEQ ID NO: 538533 - RNA, 32 nt, Human
uugaaccuaggagguugaggcuauagugagcu

SEQ ID NO: 538534 - RNA, 32 nt, Human
uugaaccuaggaguucgagaccagccugggca

SEQ ID NO: 538535 - RNA, 32 nt, Human
uugaaccuaggaguuugagaccagccugggcg

SEQ ID NO: 538536 - RNA, 32 nt, Human
uugaaccuagggaggcagagguuguagugagc

SEQ ID NO: 538537 - RNA, 32 nt, Human
uugaaccuccaggauuccacggugcuguccca

SEQ ID NO: 538538 - RNA, 32 nt, Human
uugaaccuccugcucuagccuuggcggaggga

SEQ ID NO: 538539 - RNA, 32 nt, Human
uugaaccuccuuccuccaccaggauuugaagu

SEQ ID NO: 538540 - RNA, 32 nt, Human
uugaaccucggaggcugaaguugcagugagcc

SEQ ID NO: 538541 - RNA, 32 nt, Human
uugaaccugagaggugagguugcagugagccg

SEQ ID NO: 538542 - RNA, 32 nt, Human
uugaaccugagagguggagguugcagugagcc

SEQ ID NO: 538543 - RNA, 32 nt, Human
uugaaccugaggaaaaguuaaaguguagaaaa

SEQ ID NO: 538544 - RNA, 19 nt, Human
uugaaccugcagcccuggc

SEQ ID NO: 538545 - RNA, 32 nt, Human
uugaaccugccugccuccuaccugugugagcc

SEQ ID NO: 538546 - RNA, 32 nt, Human
uugaaccugcucugcugaguccccugggccau

SEQ ID NO: 538547 - RNA, 32 nt, Human
uugaaccuggaaggcggagguugcagugagca

SEQ ID NO: 538548 - RNA, 32 nt, Human
uugaaccuggaaggcggagguugcagugagcc

SEQ ID NO: 538549 - RNA, 32 nt, Human
uugaaccuggagacagagguugcagugagcug

SEQ ID NO: 538550 - RNA, 32 nt, Human
uugaaccuggaggcagagauugcagugagccg

SEQ ID NO: 538551 - RNA, 32 nt, Human
uugaaccuggaggcagagguugcagugagucg

SEQ ID NO: 538552 - RNA, 32 nt, Human
uugaaccuggagguggagguugcagugagccg

SEQ ID NO: 538553 - RNA, 32 nt, Human
uugaaccuggcagguggagguugcagugagug

SEQ ID NO: 538554 - RNA, 32 nt, Human
uugaaccugggaaguggaggcugcagugagcc

SEQ ID NO: 538555 - RNA, 32 nt, Human
uugaaccugggagauggaaguugcagugaacc

SEQ ID NO: 538556 - RNA, 32 nt, Human
uugaaccugggagauggaggcugcaguaagcc

SEQ ID NO: 538557 - RNA, 32 nt, Human
uugaaccugggagcaggagguugcagugagcc

SEQ ID NO: 538558 - RNA, 32 nt, Human
uugaaccugggagccugagguugcagugagcc

SEQ ID NO: 538559 - RNA, 32 nt, Human
uugaaccugggaggaggagguugcagugagcu

SEQ ID NO: 538560 - RNA, 32 nt, Human
uugaaccugggaggcagauguugcagugagcc

SEQ ID NO: 538561 - RNA, 32 nt, Human
uugaaccugggaggcagcgguugcaguaagcc

SEQ ID NO: 538562 - RNA, 32 nt, Human
uugaaccugggaggcaguuugcagugagcuga

SEQ ID NO: 538563 - RNA, 32 nt, Human
uugaaccugggaggcggaaguugcagugagcc

SEQ ID NO: 538564 - RNA, 32 nt, Human
uugaaccugggaggcggaaguugcagugagcu

SEQ ID NO: 538565 - RNA, 32 nt, Human
uugaaccugggaggcggaggcugcagugagcc

SEQ ID NO: 538566 - RNA, 32 nt, Human
uugaaccugggaggcggaggcugcagugagcu

SEQ ID NO: 538567 - RNA, 32 nt, Human
uugaaccugggaggcggagguugcaguaagcc

SEQ ID NO: 538568 - RNA, 32 nt, Human
uugaaccugggaggcggagguugcagugagcc

SEQ ID NO: 538569 - RNA, 32 nt, Human
uugaaccugggaggcggagguugcagugagcg

SEQ ID NO: 538570 - RNA, 32 nt, Human
uugaaccugggaggcggagguugcagugagcu

SEQ ID NO: 538571 - RNA, 32 nt, Human
uugaaccugggaggcggagguugcagugaguc

SEQ ID NO: 538572 - RNA, 32 nt, Human
uugaaccugggaggcggagguugcagugaguu

SEQ ID NO: 538573 - RNA, 32 nt, Human
uugaaccugggaggcugaaguugcagugagcc

SEQ ID NO: 538574 - RNA, 32 nt, Human
uugaaccugggagggcggagguugcagugagc

SEQ ID NO: 538575 - RNA, 32 nt, Human
uugaaccugggagguacagguugcagugagcc

SEQ ID NO: 538576 - RNA, 32 nt, Human
uugaaccugggagguagaaguugcagugagcc

SEQ ID NO: 538577 - RNA, 32 nt, Human
uugaaccugggagguagagguugcagugagcc

SEQ ID NO: 538578 - RNA, 32 nt, Human
uugaaccugggagguggaaguugcagugagcc

SEQ ID NO: 538579 - RNA, 32 nt, Human
uugaaccugggagguggaaguugcagugagcu

SEQ ID NO: 538580 - RNA, 32 nt, Human
uugaaccugggagguggaggcagugagcugag

SEQ ID NO: 538581 - RNA, 32 nt, Human
uugaaccugggagguggagguugcaguaagcc

SEQ ID NO: 538582 - RNA, 32 nt, Human
uugaaccugggagguggagguugcaguaagcu

SEQ ID NO: 538583 - RNA, 32 nt, Human
uugaaccugggagguggagguugcagugagca

SEQ ID NO: 538584 - RNA, 32 nt, Human
uugaaccugggagguggagguugcagugagcc

SEQ ID NO: 538585 - RNA, 32 nt, Human
uugaaccugggagguggagguugcagugagcu

SEQ ID NO: 538586 - RNA, 32 nt, Human
uugaaccugggagguggagguugcagugaguc

SEQ ID NO: 538587 - RNA, 32 nt, Human
uugaaccugggagguggagguugcagugaguu

SEQ ID NO: 538588 - RNA, 32 nt, Human
uugaaccugggagguggagguugcagugggcc

SEQ ID NO: 538589 - RNA, 32 nt, Human
uugaaccugggagguggagguugcagugggcu

SEQ ID NO: 538590 - RNA, 32 nt, Human
uugaaccugggagguggaguugcagugagccg

SEQ ID NO: 538591 - RNA, 32 nt, Human
uugaaccugggagguggauguugcagugagcu

SEQ ID NO: 538592 - RNA, 32 nt, Human
uugaaccugggagguggugguugcagugagcu

SEQ ID NO: 538593 - RNA, 32 nt, Human
uugaaccugggaguuggagguugcagugaaac

SEQ ID NO: 538594 - RNA, 32 nt, Human
uugaaccuggguggucgaggcugcagugagcc

SEQ ID NO: 538595 - RNA, 32 nt, Human
uugaaccuuauguaccgagcaaaugccagguc

SEQ ID NO: 538596 - RNA, 32 nt, Human
uugaacgaagugaaaaagcugcuaaaaaccaa

SEQ ID NO: 538597 - RNA, 32 nt, Human
uugaacgcaggaggcugaggcugcagugaguu

SEQ ID NO: 538598 - RNA, 32 nt, Human
uugaacgcugggagaaugcugggagccugcug

SEQ ID NO: 538599 - RNA, 32 nt, Human
uugaacgggucgagaugccgaccucagccuca

SEQ ID NO: 538600 - RNA, 32 nt, Human
uugaacguucacuaaaucuucaagcaaaaaca

SEQ ID NO: 538601 - RNA, 32 nt, Human
uugaacuacuaaauaugaaaauaagucauuug

SEQ ID NO: 538602 - RNA, 19 nt, Human
uugaacuacuuggggccuu

SEQ ID NO: 538603 - RNA, 32 nt, Human
uugaacuaggaggcagagguugcagugagccg

SEQ ID NO: 538604 - RNA, 32 nt, Human
uugaacucacugcucacugacaucuuaauugc

SEQ ID NO: 538605 - RNA, 32 nt, Human
uugaacucagaaggcggaggcugcagugagcc

SEQ ID NO: 538606 - RNA, 32 nt, Human
uugaacucagaagguggagguugcagugaggc

SEQ ID NO: 538607 - RNA, 32 nt, Human
uugaacucagaaguucaagaccagucugggca

SEQ ID NO: 538608 - RNA, 32 nt, Human
uugaacucaggaauucgagaccagccugggcu

SEQ ID NO: 538609 - RNA, 32 nt, Human
uugaacucaggagguggagguugcagugagcu

SEQ ID NO: 538610 - RNA, 32 nt, Human
uugaacucaggaguucaagaccagccugggaa

SEQ ID NO: 538611 - RNA, 32 nt, Human
uugaacucaggaguucaagaccagccugggca

SEQ ID NO: 538612 - RNA, 32 nt, Human
uugaacucaggaguuggagaccagccugggca

SEQ ID NO: 538613 - RNA, 32 nt, Human
uugaacucaggaguuuaagaccagccugggca

SEQ ID NO: 538614 - RNA, 32 nt, Human
uugaacucaggaguuugagaccagcuugggca

SEQ ID NO: 538615 - RNA, 20 nt, Human
uugaacucagggcccaagca

SEQ ID NO: 538616 - RNA, 18 nt, Human
uugaacuccagccccgca

SEQ ID NO: 538617 - RNA, 32 nt, Human
uugaacucccaaagugcugggauuacaggcgu

SEQ ID NO: 538618 - RNA, 32 nt, Human
uugaacucccagacucaagugauccuuccacc

SEQ ID NO: 538619 - RNA, 32 nt, Human
uugaacucccagucuccagaauagcugggacu

SEQ ID NO: 538620 - RNA, 32 nt, Human
uugaacuccugggcuacaguuacccuccuacc

SEQ ID NO: 538621 - RNA, 32 nt, Human
uugaacucgggaggcggagguugcagugagcc

SEQ ID NO: 538622 - RNA, 32 nt, Human
uugaacucgggaggcggauguugcagugagcc

SEQ ID NO: 538623 - RNA, 32 nt, Human
uugaacucgggaggugaaaguugcagugagcc

SEQ ID NO: 538624 - RNA, 32 nt, Human
uugaacucgggagguggagguugcagucagcc

SEQ ID NO: 538625 - RNA, 32 nt, Human
uugaacucgggagguggagguugcagugagcu

SEQ ID NO: 538626 - RNA, 32 nt, Human
uugaacucuuaugguugggacauucuuuuccu

SEQ ID NO: 538627 - RNA, 32 nt, Human
uugaacucuucggggguccuguugacccauuu

SEQ ID NO: 538628 - RNA, 32 nt, Human
uugaacugaccuuugauugguuucugcuucaa

SEQ ID NO: 538629 - RNA, 32 nt, Human
uugaacugaggagguggagguugcagugagcc

SEQ ID NO: 538630 - RNA, 32 nt, Human
uugaacugaggcagaggcuacagugaguggag

SEQ ID NO: 538631 - RNA, 32 nt, Human
uugaacugccaagaaaaggcauggagacagcg

SEQ ID NO: 538632 - RNA, 32 nt, Human
uugaacugcccuccucuccacccagcugcugc

SEQ ID NO: 538633 - RNA, 17 nt, Human
uugaacuggaaggucug

SEQ ID NO: 538634 - RNA, 32 nt, Human
uugaacuuaauggagcuuauguugagaaauaa

SEQ ID NO: 538635 - RNA, 32 nt, Human
uugaacuucagcuccagugucucuccagaaua

SEQ ID NO: 538636 - RNA, 32 nt, Human
uugaacuuccaugaaaccugucuuccaccaca

SEQ ID NO: 538637 - RNA, 22 nt, Human
uugaacuuccuaugaauggagu

SEQ ID NO: 538638 - RNA, 32 nt, Human
uugaacuugggagggguagguugcagugagcu

SEQ ID NO: 538639 - RNA, 32 nt, Human
uugaacuugggagguggagguugcagugagcc

SEQ ID NO: 538640 - RNA, 32 nt, Human
uugaacuugggagguggagguugcagugggcc

SEQ ID NO: 538641 - RNA, 22 nt, Human
uugaacuuucacauagcacaga

SEQ ID NO: 538642 - RNA, 32 nt, Human
uugaacuuuuauuuucuuguugauuauaaauc

SEQ ID NO: 538643 - RNA, 32 nt, Human
uugaacuuuuccuagggauuccgcuccacccg

SEQ ID NO: 538644 - RNA, 32 nt, Human
uugaagaaaaggagguuccagccuuggcaaga

SEQ ID NO: 538645 - RNA, 32 nt, Human
uugaagaagaaauggagaagcacagaaguaau

SEQ ID NO: 538646 - RNA, 32 nt, Human
uugaagaagaggcauccuucucugaugugcac

SEQ ID NO: 538647 - RNA, 32 nt, Human
uugaagaagauguaagaaugugucaagaccau

SEQ ID NO: 538648 - RNA, 32 nt, Human
uugaagaagccauggcgaaaucaaagacaaaa

SEQ ID NO: 538649 - RNA, 32 nt, Human
uugaagaagggccuucacacacaaaaccugau

SEQ ID NO: 538650 - RNA, 32 nt, Human
uugaagaauccugaugaaauauucaaacacau

SEQ ID NO: 538651 - RNA, 32 nt, Human
uugaagaaugcagcagccuuuuuguaaacuuc

SEQ ID NO: 538652 - RNA, 22 nt, Human
uugaagacaguuuaaagccaca

SEQ ID NO: 538653 - RNA, 32 nt, Human
uugaagaccagccugagaaauaaggugaaacc

SEQ ID NO: 538654 - RNA, 32 nt, Human
uugaagaccagccuggccaacauggcaaaaac

SEQ ID NO: 538655 - RNA, 32 nt, Human
uugaagaccagccuggccaacauggugaaacc

SEQ ID NO: 538656 - RNA, 32 nt, Human
uugaagaccagccugggcaacacagugagacu

SEQ ID NO: 538657 - RNA, 32 nt, Human
uugaagaccagccugggcaacauagugagaaa

SEQ ID NO: 538658 - RNA, 32 nt, Human
uugaagacccuuuaaagcagugaaucugaaac

SEQ ID NO: 538659 - RNA, 32 nt, Human
uugaagacuaggcuuuggagguuuucaaagca

SEQ ID NO: 538660 - RNA, 32 nt, Human
uugaagagcuaagaaaaucacugcaggaaaaa

SEQ ID NO: 538661 - RNA, 32 nt, Human
uugaagagcuaagaaaaucgcugcaggaaaaa

SEQ ID NO: 538662 - RNA, 32 nt, Human
uugaagagcuaguuaacaagcacagaaaauau

SEQ ID NO: 538663 - RNA, 32 nt, Human
uugaagaggaaagacuaguggacagggaggcc

SEQ ID NO: 538664 - RNA, 32 nt, Human
uugaagagggagacaagcuaaaagaggauauc

SEQ ID NO: 538665 - RNA, 32 nt, Human
uugaagagugcagcuuaauaaaugccagggaa

SEQ ID NO: 538666 - RNA, 32 nt, Human
uugaagaucggguugaggauuggggcuagcuc

SEQ ID NO: 538667 - RNA, 32 nt, Human
uugaagauuguggucuggcauaaggagaggug

SEQ ID NO: 538668 - RNA, 32 nt, Human
uugaagcacaguugucaguaggaaagggugga

SEQ ID NO: 538669 - RNA, 32 nt, Human
uugaagcagcaacuaucaagucugaaaagcaa

SEQ ID NO: 538670 - RNA, 32 nt, Human
uugaagcaggaggggcuggauuuggaaaaguc

SEQ ID NO: 538671 - RNA, 32 nt, Human
uugaagcaggaucagacccagccagcagagau

SEQ ID NO: 538672 - RNA, 32 nt, Human
uugaagcaguguuugcacggcaagcgcagcuu

SEQ ID NO: 538673 - RNA, 32 nt, Human
uugaagccaaaggaaucucacuuguggggccu

SEQ ID NO: 538674 - RNA, 32 nt, Human
uugaagccaccaaacugagaccuugauaccuu

SEQ ID NO: 538675 - RNA, 18 nt, Human
uugaagccacgcgcucca

SEQ ID NO: 538676 - RNA, 31 nt, Human
uugaagccacucaagccaguuggggaggaaa

SEQ ID NO: 538677 - RNA, 32 nt, Human
uugaagccacugccuucaccuucaccuucauc

SEQ ID NO: 538678 - RNA, 32 nt, Human
uugaagccagaaguucaagaccagccugcaca

SEQ ID NO: 538679 - RNA, 32 nt, Human
uugaagccagaggcagagguugcaaugagccg

SEQ ID NO: 538680 - RNA, 32 nt, Human
uugaagccaggacuucaagaccagcuuggcca

SEQ ID NO: 538681 - RNA, 32 nt, Human
uugaagccaggaggagagaugcagucuuagga

SEQ ID NO: 538682 - RNA, 32 nt, Human
uugaagccaggaggcggagguugcagugagcc

SEQ ID NO: 538683 - RNA, 32 nt, Human
uugaagccaggaguucaagaccagccuggcca

SEQ ID NO: 538684 - RNA, 32 nt, Human
uugaagccaggaguuccagaccagccugggca

SEQ ID NO: 538685 - RNA, 32 nt, Human
uugaagccaggaguuggagaccagccuaggca

SEQ ID NO: 538686 - RNA, 32 nt, Human
uugaagccaggaguuugagaccagcuuggaua

SEQ ID NO: 538687 - RNA, 32 nt, Human
uugaagccaggaguuugggaccagccugggca

SEQ ID NO: 538688 - RNA, 32 nt, Human
uugaagccaguaguucaagaccagccugggca

SEQ ID NO: 538689 - RNA, 32 nt, Human
uugaagccaguucaguaaucacacacauucca

SEQ ID NO: 538690 - RNA, 32 nt, Human
uugaagccgggagguggggguugcagugagcc

SEQ ID NO: 538691 - RNA, 32 nt, Human
uugaagccuagaauugucagcacuuccaacuu

SEQ ID NO: 538692 - RNA, 32 nt, Human
uugaagccuauuguuauaauuucuguugaaua

SEQ ID NO: 538693 - RNA, 32 nt, Human
uugaagccucagccuuccaucuguaaagggcg

SEQ ID NO: 538694 - RNA, 32 nt, Human
uugaagccucgcacuccugggcucaagugguc

SEQ ID NO: 538695 - RNA, 32 nt, Human
uugaagccugacuccauucuauuugccuggag

SEQ ID NO: 538696 - RNA, 32 nt, Human
uugaagcgacccggaagcggaaguggaagaaa

SEQ ID NO: 538697 - RNA, 32 nt, Human
uugaagcggagaccauuuccaggccuuauuga

SEQ ID NO: 538698 - RNA, 32 nt, Human
uugaagcuaggaguuagagaccagccugggca

SEQ ID NO: 538699 - RNA, 32 nt, Human
uugaagcuaggaguuugagaccagccugggca

SEQ ID NO: 538700 - RNA, 32 nt, Human
uugaagcuaguucaguaaucacacacauucca

SEQ ID NO: 538701 - RNA, 32 nt, Human
uugaagcuauucuccccuaauuaauaucucga

SEQ ID NO: 538702 - RNA, 32 nt, Human
uugaagcucaacuccauuguuuccagguguug

SEQ ID NO: 538703 - RNA, 32 nt, Human
uugaagcucuuguccugcacugucuuuaggua

SEQ ID NO: 538704 - RNA, 32 nt, Human
uugaagcugaccuaaucucuuugccuaacaac

SEQ ID NO: 538705 - RNA, 32 nt, Human
uugaagcugagaguucaagaccaaccugggca

SEQ ID NO: 538706 - RNA, 32 nt, Human
uugaagcuggaaaaccagauagauaggacaac

SEQ ID NO: 538707 - RNA, 32 nt, Human
uugaagcuggaaaaccagauagauggguugac

SEQ ID NO: 538708 - RNA, 32 nt, Human
uugaagcuggaaaaccugauaggugagacuac

SEQ ID NO: 538709 - RNA, 32 nt, Human
uugaagcugggcugucucucuccauguuggcc

SEQ ID NO: 538710 - RNA, 32 nt, Human
uugaagcuggugccucauugaggccauauuag

SEQ ID NO: 538711 - RNA, 32 nt, Human
uugaagcugugauugacauuuuucucauaaug

SEQ ID NO: 538712 - RNA, 32 nt, Human
uugaaggaaaugcaguguucugagggccccuu

SEQ ID NO: 538713 - RNA, 32 nt, Human
uugaaggaaguggagacauaaggagagacaaa

SEQ ID NO: 538714 - RNA, 32 nt, Human
uugaaggaaugaacuaacaccaaccaaccaaa

SEQ ID NO: 538715 - RNA, 25 nt, Human
uugaaggacaggagagaugucaggu

SEQ ID NO: 538716 - RNA, 32 nt, Human
uugaaggaccuccuucccccagccucaucacc

SEQ ID NO: 538717 - RNA, 32 nt, Human
uugaaggagagcagcaaaaauguaucaggggu

SEQ ID NO: 538718 - RNA, 32 nt, Human
uugaaggagagggagagggauccuggcccagc

SEQ ID NO: 538719 - RNA, 18 nt, Human
uugaaggagagggugagg

SEQ ID NO: 538720 - RNA, 32 nt, Human
uugaaggaggcacgugggggaggcgggagugg

SEQ ID NO: 538721 - RNA, 32 nt, Human
uugaaggaggcagaagggagagugaugcacga

SEQ ID NO: 538722 - RNA, 32 nt, Human
uugaaggaggcagcgggagcggagagcgcccu

SEQ ID NO: 538723 - RNA, 31 nt, Human
uugaaggaucuacuggagguguuuguaagga

SEQ ID NO: 538724 - RNA, 31 nt, Human
uugaaggcaaugucuuuucucucuguuaaga

SEQ ID NO: 538725 - RNA, 32 nt, Human
uugaaggcagagggguugggauggagcuuuau

SEQ ID NO: 538726 - RNA, 32 nt, Human
uugaaggcaggaguucaagaccagcuugggca

SEQ ID NO: 538727 - RNA, 32 nt, Human
uugaaggcaguuucagaucgccaccuuuugag

SEQ ID NO: 538728 - RNA, 32 nt, Human
uugaaggccagccugcaucucgcggugugugu

SEQ ID NO: 538729 - RNA, 32 nt, Human
uugaaggccagccugggaaacauggcaaaauc

SEQ ID NO: 538730 - RNA, 32 nt, Human
uugaaggccccaaggaguucuugggugugggu

SEQ ID NO: 538731 - RNA, 32 nt, Human
uugaaggccuccaguucccagggggaaggaag

SEQ ID NO: 538732 - RNA, 32 nt, Human
uugaaggccucgcuuaguuguacuggauucuc

SEQ ID NO: 538733 - RNA, 22 nt, Human
uugaaggccuggaauuuucaca

SEQ ID NO: 538734 - RNA, 32 nt, Human
uugaaggcucaagcuucagggagcuggcagag

SEQ ID NO: 538735 - RNA, 32 nt, Human
uugaaggcucccugggacuuaagggcccucag

SEQ ID NO: 538736 - RNA, 32 nt, Human
uugaagggaucuuccagccucugccucccgaa

SEQ ID NO: 538737 - RNA, 32 nt, Human
uugaagggcaagaaauggcgucugcucuggug

SEQ ID NO: 538738 - RNA, 31 nt, Human
uugaaggggacacagucuaggagggggauaa

SEQ ID NO: 538739 - RNA, 32 nt, Human
uugaaggggugauugcugacuagcggggaggg

SEQ ID NO: 538740 - RNA, 31 nt, Human
uugaagguacuuuucugguauuuuaagauuc

SEQ ID NO: 538741 - RNA, 32 nt, Human
uugaaggucuggaucccuuucucugaauggag

SEQ ID NO: 538742 - RNA, 32 nt, Human
uugaaggugaccucugccccagauagguggug

SEQ ID NO: 538743 - RNA, 32 nt, Human
uugaagguggccugagaauggagcuucucuuu

SEQ ID NO: 538744 - RNA, 32 nt, Human
uugaaggugucuuggcaucuucugccuuugcu

SEQ ID NO: 538745 - RNA, 32 nt, Human
uugaagguuccccugagguugcauggugacca

SEQ ID NO: 538746 - RNA, 32 nt, Human
uugaagguucugucaccuuuugcaguggucca

SEQ ID NO: 538747 - RNA, 32 nt, Human
uugaagguuuguccaggcagagcagcuccugc

SEQ ID NO: 538748 - RNA, 32 nt, Human
uugaagguuuguggagagcguggagaaugaug

SEQ ID NO: 538749 - RNA, 32 nt, Human
uugaagguuuugucccuuccucuccuccuucc

SEQ ID NO: 538750 - RNA, 32 nt, Human
uugaaguaacugaaauaaaacucucuccaagc

SEQ ID NO: 538751 - RNA, 32 nt, Human
uugaaguaggaagggagccagagaggccgaug

SEQ ID NO: 538752 - RNA, 32 nt, Human
uugaaguagggaggaggagguugcagugagcu

SEQ ID NO: 538753 - RNA, 32 nt, Human
uugaaguauaucugagggaaaaauaaaugaaa

SEQ ID NO: 538754 - RNA, 32 nt, Human
uugaaguauugauaacaccaaggaacucuauc

SEQ ID NO: 538755 - RNA, 32 nt, Human
uugaagucacacuguaaccucagucuaccccu

SEQ ID NO: 538756 - RNA, 32 nt, Human
uugaagucaggaguucaagaccaaccugggca

SEQ ID NO: 538757 - RNA, 32 nt, Human
uugaagucaggaguucaagaccagccuggcca

SEQ ID NO: 538758 - RNA, 32 nt, Human
uugaagucaggaguuugagaccagccugacca

SEQ ID NO: 538759 - RNA, 32 nt, Human
uugaagucaggaguuugagaccagccuggcca

SEQ ID NO: 538760 - RNA, 32 nt, Human
uugaagucaggaguuugagaccagccuggcug

SEQ ID NO: 538761 - RNA, 32 nt, Human
uugaaguccagccuaagcaacauagugaaacc

SEQ ID NO: 538762 - RNA, 32 nt, Human
uugaaguccuccagacaacccucagauuugau

SEQ ID NO: 538763 - RNA, 21 nt, Human
uugaaguccuccugugccagg

SEQ ID NO: 538764 - RNA, 32 nt, Human
uugaagucgggaguuuaagaccagccuggcca

SEQ ID NO: 538765 - RNA, 32 nt, Human
uugaagugauucucgugucucagucuuccgag

SEQ ID NO: 538766 - RNA, 32 nt, Human
uugaaguggguggaucaccugaggucaggagu

SEQ ID NO: 538767 - RNA, 32 nt, Human
uugaaguguguagaguauauuauaguaacuga

SEQ ID NO: 538768 - RNA, 32 nt, Human
uugaaguucccucugcugagucgcccuugugc

SEQ ID NO: 538769 - RNA, 32 nt, Human
uugaaguucuucucccugguggcuuaagagcc

SEQ ID NO: 538770 - RNA, 32 nt, Human
uugaaguugcaagccuuugucuuacucuuuca

SEQ ID NO: 538771 - RNA, 32 nt, Human
uugaaguuuacauuuccaugugcuguugauca

SEQ ID NO: 538772 - RNA, 32 nt, Human
uugaaguuucaggauuugggugucacaaagga

SEQ ID NO: 538773 - RNA, 32 nt, Human
uugaaguuuucagggauaacauaccugaugga

SEQ ID NO: 538774 - RNA, 32 nt, Human
uugaauaaaagcaguaagacauuuuauuacca

SEQ ID NO: 538775 - RNA, 32 nt, Human
uugaauaaguaguuuucauguuuucaauaugc

SEQ ID NO: 538776 - RNA, 32 nt, Human
uugaauaauguucaugaccacaggcugccaua

SEQ ID NO: 538777 - RNA, 32 nt, Human
uugaauacauguugggaagaaucggugucuua

SEQ ID NO: 538778 - RNA, 32 nt, Human
uugaauaccccagcuucugcagcuucacuugc

SEQ ID NO: 538779 - RNA, 32 nt, Human
uugaauacucgggaaauucaaagggaagugug

SEQ ID NO: 538780 - RNA, 32 nt, Human
uugaauacucugagagaagagagacagacccu

SEQ ID NO: 538781 - RNA, 32 nt, Human
uugaauacuugaaucaugcaggccaauauuau

SEQ ID NO: 538782 - RNA, 32 nt, Human
uugaauacuuguuucuuuagcacuuugaagau

SEQ ID NO: 538783 - RNA, 32 nt, Human
uugaauagguauuguaaauggaagcgcuuacc

SEQ ID NO: 538784 - RNA, 32 nt, Human
uugaauaguauguuacugcagcuuugguaaca

SEQ ID NO: 538785 - RNA, 22 nt, Human
uugaauagugcuuuucucccua

SEQ ID NO: 538786 - RNA, 32 nt, Human
uugaauauacucauguuaagugcaauggcauu

SEQ ID NO: 538787 - RNA, 32 nt, Human
uugaauaucacacugaauacaggugucaccac

SEQ ID NO: 538788 - RNA, 32 nt, Human
uugaauaucugacuucuucugcagccagcugg

SEQ ID NO: 538789 - RNA, 32 nt, Human
uugaauaugagguucaggagauagguucagga

SEQ ID NO: 538790 - RNA, 32 nt, Human
uugaauaugugcacacuggacugugaguuucu

SEQ ID NO: 538791 - RNA, 32 nt, Human
uugaaucaaagcaguuaacuuuaagacugagc

SEQ ID NO: 538792 - RNA, 32 nt, Human
uugaaucacaacaaaauuagauuuguacauag

SEQ ID NO: 538793 - RNA, 32 nt, Human
uugaaucacagaauagcgguaccaugauagaa

SEQ ID NO: 538794 - RNA, 32 nt, Human
uugaaucacuugacaguguuuguuugaauugu

SEQ ID NO: 538795 - RNA, 32 nt, Human
uugaaucagcuugucuaacaagcccauuuuca

SEQ ID NO: 538796 - RNA, 32 nt, Human
uugaauccagcaggccaauagugaaaugugaa

SEQ ID NO: 538797 - RNA, 32 nt, Human
uugaauccaggaggaggagguugcagugagcc

SEQ ID NO: 538798 - RNA, 32 nt, Human
uugaauccaggaggcagagguugcagugagug

SEQ ID NO: 538799 - RNA, 32 nt, Human
uugaauccaggaggcgaagguugcagugagcu

SEQ ID NO: 538800 - RNA, 32 nt, Human
uugaauccaggaggcggagguugcagugaacc

SEQ ID NO: 538801 - RNA, 32 nt, Human
uugaauccaggaggcggagguugcagugagcc

SEQ ID NO: 538802 - RNA, 32 nt, Human
uugaauccaggaguucaagaccagcaugggga

SEQ ID NO: 538803 - RNA, 32 nt, Human
uugaauccaggcauuugagaccagccugggua

SEQ ID NO: 538804 - RNA, 32 nt, Human
uugaaucccaggagacagagguugcagugagc

SEQ ID NO: 538805 - RNA, 32 nt, Human
uugaaucccugaguucuguacuguucuguuuu

SEQ ID NO: 538806 - RNA, 32 nt, Human
uugaauccgggaggcggagguugcagugaacc

SEQ ID NO: 538807 - RNA, 32 nt, Human
uugaauccgggagguggagguugcagugagcc

SEQ ID NO: 538808 - RNA, 32 nt, Human
uugaaucucuacccucucccaccacacaguac

SEQ ID NO: 538809 - RNA, 32 nt, Human
uugaaucucuuucuggcccauccucugcuuca

SEQ ID NO: 538810 - RNA, 32 nt, Human
uugaaucugggagguggagguugcagugagcc

SEQ ID NO: 538811 - RNA, 32 nt, Human
uugaaucugguucauugcguccucguguucuu

SEQ ID NO: 538812 - RNA, 32 nt, Human
uugaaucuuaggaaugaacagugucucaagcu

SEQ ID NO: 538813 - RNA, 32 nt, Human
uugaaucuuuaccagggcuucccaccuccugu

SEQ ID NO: 538814 - RNA, 32 nt, Human
uugaaucuuuccaauaaaccagguuuagacag

SEQ ID NO: 538815 - RNA, 32 nt, Human
uugaaugaaagaagccaggccgaaguuccauu

SEQ ID NO: 538816 - RNA, 32 nt, Human
uugaaugaaaguacaguuccauuuggaagccc

SEQ ID NO: 538817 - RNA, 32 nt, Human
uugaaugaagucuucuuggauuucacccaacu

SEQ ID NO: 538818 - RNA, 32 nt, Human
uugaaugaauacagaugcauuauccagaacug

SEQ ID NO: 538819 - RNA, 32 nt, Human
uugaaugaggaaugggaugaagauagauagug

SEQ ID NO: 538820 - RNA, 32 nt, Human
uugaaugauuggaucaggcccacccagauuac

SEQ ID NO: 538821 - RNA, 31 nt, Human
uugaaugcacuuuugcucauggugaauauag

SEQ ID NO: 538822 - RNA, 31 nt, Human
uugaaugcacuuuuuaugacaaugauucagu

SEQ ID NO: 538823 - RNA, 32 nt, Human
uugaaugcccaggaguuaaaugucuuaagaua

SEQ ID NO: 538824 - RNA, 32 nt, Human
uugaaugccugcugcuuguuuacccuuuggaa

SEQ ID NO: 538825 - RNA, 29 nt, Human
uugaaugccuggggucugccuccgccucu

SEQ ID NO: 538826 - RNA, 32 nt, Human
uugaaugccuuauauuguauacauuccuuuca

SEQ ID NO: 538827 - RNA, 32 nt, Human
uugaaugcucaauuccuuacaaaaucuucauu

SEQ ID NO: 538828 - RNA, 32 nt, Human
uugaaugcugcuuccugcucccuccauggacc

SEQ ID NO: 538829 - RNA, 32 nt, Human
uugaauggcacaaugcuuacagagguagauug

SEQ ID NO: 538830 - RNA, 32 nt, Human
uugaauggcaggcagugauuuggaagugggag

SEQ ID NO: 538831 - RNA, 32 nt, Human
uugaauggccaauccuuccaucuggaggccug

SEQ ID NO: 538832 - RNA, 32 nt, Human
uugaauggcguuuagagaagauagaaaagaau

SEQ ID NO: 538833 - RNA, 32 nt, Human
uugaauggcuggaaccaagaugacagauggag

SEQ ID NO: 538834 - RNA, 32 nt, Human
uugaauggcuggccugugauggauggcuggcc

SEQ ID NO: 538835 - RNA, 32 nt, Human
uugaaugguauaauacaguccucuccggugga

SEQ ID NO: 538836 - RNA, 32 nt, Human
uugaaugguggagggaggcaguggggagaaag

SEQ ID NO: 538837 - RNA, 32 nt, Human
uugaauguauuuuuaugagauuuuaaccagaa

SEQ ID NO: 538838 - RNA, 32 nt, Human
uugaaugucuaacucaaaccucucauuuuugu

SEQ ID NO: 538839 - RNA, 32 nt, Human
uugaaugugccaaacuuuuucguaacuuuuga

SEQ ID NO: 538840 - RNA, 32 nt, Human
uugaauguucaaguaucucauccacucaguuu

SEQ ID NO: 538841 - RNA, 32 nt, Human
uugaauguugaauguuugaauuacagggaaga

SEQ ID NO: 538842 - RNA, 32 nt, Human
uugaauguuuaaauauaugagacacucuuugu

SEQ ID NO: 538843 - RNA, 32 nt, Human
uugaauguuugaauuacagggaagaaaucaag

SEQ ID NO: 538844 - RNA, 32 nt, Human
uugaauguuuuugcccaaaugucuauaccaaa

SEQ ID NO: 538845 - RNA, 32 nt, Human
uugaauuacaucugggcaaucaggagauaauu

SEQ ID NO: 538846 - RNA, 32 nt, Human
uugaauuacgugccccacacuguggcuuagga

SEQ ID NO: 538847 - RNA, 32 nt, Human
uugaauuaggaguauacuuggugaggaaagag

SEQ ID NO: 538848 - RNA, 32 nt, Human
uugaauucaggaggcggagguugcagugagcc

SEQ ID NO: 538849 - RNA, 32 nt, Human
uugaauucaggagguggagguugcagugagcc

SEQ ID NO: 538850 - RNA, 32 nt, Human
uugaauucccggcuggagagcuggcaggaccc

SEQ ID NO: 538851 - RNA, 32 nt, Human
uugaauucccuggauaguccaagcuuugugga

SEQ ID NO: 538852 - RNA, 32 nt, Human
uugaauuccucuuucuuguuuucuuuccuggu

SEQ ID NO: 538853 - RNA, 32 nt, Human
uugaauucgggagguggagguugcagugagcc

SEQ ID NO: 538854 - RNA, 21 nt, Human
uugaauucuaaauucagcaca

SEQ ID NO: 538855 - RNA, 32 nt, Human
uugaauucuaguuuagaguuagcagacuaccc

SEQ ID NO: 538856 - RNA, 32 nt, Human
uugaauucucagauugcccugaauuuugccac

SEQ ID NO: 538857 - RNA, 32 nt, Human
uugaauucugccaaacauuaaaauuagcacua

SEQ ID NO: 538858 - RNA, 32 nt, Human
uugaauucugccucuucuugcucacuguguga

SEQ ID NO: 538859 - RNA, 32 nt, Human
uugaauuggaaagagaagagugaagauccaag

SEQ ID NO: 538860 - RNA, 22 nt, Human
uugaauugggauaaacagagag

SEQ ID NO: 538861 - RNA, 32 nt, Human
uugaauuguauaugcucucacucugaaauucc

SEQ ID NO: 538862 - RNA, 32 nt, Human
uugaauuguauaugugaauuggaaguuauaau

SEQ ID NO: 538863 - RNA, 32 nt, Human
uugaauuguauucccguaauucccagguguug

SEQ ID NO: 538864 - RNA, 32 nt, Human
uugaauugucucucacacuuuucagucaagag

SEQ ID NO: 538865 - RNA, 32 nt, Human
uugaauuguuauuuaaaucaaaccagauguaa

SEQ ID NO: 538866 - RNA, 32 nt, Human
uugaauuuauucugugguaaaucuuuugaguu

SEQ ID NO: 538867 - RNA, 32 nt, Human
uugaauuucuacaaauggugaaauuuaauguu

SEQ ID NO: 538868 - RNA, 32 nt, Human
uugaauuugcccagguaggcgugagagugugg

SEQ ID NO: 538869 - RNA, 32 nt, Human
uugaauuuguaacuuuuuccauuaaacaauaa

SEQ ID NO: 538870 - RNA, 30 nt, Human
uugaauuuuaauaaauaguugaaucagcgu

SEQ ID NO: 538871 - RNA, 32 nt, Human
uugaauuuuacauggcuggagcuagaauuuga

SEQ ID NO: 538872 - RNA, 32 nt, Human
uugaauuuuccucaucuugaaagacucuuggg

SEQ ID NO: 538873 - RNA, 32 nt, Human
uugaauuuuuccugguacgaagacagauauuu

SEQ ID NO: 538874 - RNA, 32 nt, Human
uugacaaaauaacauuugaguauccgauucgc

SEQ ID NO: 538875 - RNA, 32 nt, Human
uugacaaacugcaccauagguguuuuuagacu

SEQ ID NO: 538876 - RNA, 32 nt, Human
uugacaaagaaauauuucaucuggccuuuacu

SEQ ID NO: 538877 - RNA, 32 nt, Human
uugacaaagugacugugcuugauucuauacau

SEQ ID NO: 538878 - RNA, 21 nt, Human
uugacaaaugcugacagggug

SEQ ID NO: 538879 - RNA, 24 nt, Human
uugacaaauuuuauuacuuugcca

SEQ ID NO: 538880 - RNA, 32 nt, Human
uugacaacagcaucuggucuacuagacuuucu

SEQ ID NO: 538881 - RNA, 32 nt, Human
uugacaacaguacauauaucuauuucucuagg

SEQ ID NO: 538882 - RNA, 32 nt, Human
uugacaacauggugaaaccccaucucugguag

SEQ ID NO: 538883 - RNA, 21 nt, Human
uugacaacccugccuuugagg

SEQ ID NO: 538884 - RNA, 32 nt, Human
uugacaacuaucuccuugcccucuggcccugg

SEQ ID NO: 538885 - RNA, 32 nt, Human
uugacaacuucugccacucccaugucagauga

SEQ ID NO: 538886 - RNA, 32 nt, Human
uugacaagauuagcucaagcagauagagucgg

SEQ ID NO: 538887 - RNA, 32 nt, Human
uugacaagcaucaggauuccaggaggauucuu

SEQ ID NO: 538888 - RNA, 32 nt, Human
uugacaagcuguagaacuggauucauuuuuaa

SEQ ID NO: 538889 - RNA, 32 nt, Human
uugacaaguccugcuuggccugauggguggga

SEQ ID NO: 538890 - RNA, 20 nt, Human
uugacaagugcaugauuuca

SEQ ID NO: 538891 - RNA, 32 nt, Human
uugacaauccaaaggugcagaaagcacucuga

SEQ ID NO: 538892 - RNA, 32 nt, Human
uugacaaugaacaucugggcugccuuguagag

SEQ ID NO: 538893 - RNA, 32 nt, Human
uugacaauguuuucuaugaucugaaccuguca

SEQ ID NO: 538894 - RNA, 32 nt, Human
uugacaauuuccaaccucccucauuaccaaga

SEQ ID NO: 538895 - RNA, 32 nt, Human
uugacacaaaagacaggagcaggguccagguu

SEQ ID NO: 538896 - RNA, 32 nt, Human
uugacacaccuuguagucuaaauguucgguau

SEQ ID NO: 538897 - RNA, 32 nt, Human
uugacacacuguuacuguccagucucuacaca

SEQ ID NO: 538898 - RNA, 32 nt, Human
uugacacagaguuuugcucuuguugcccaggc

SEQ ID NO: 538899 - RNA, 22 nt, Human
uugacacauggauuucagcuca

SEQ ID NO: 538900 - RNA, 32 nt, Human
uugacaccaagaaaccacugggcauaaugcuu

SEQ ID NO: 538901 - RNA, 32 nt, Human
uugacaccagaugagccugaaucuaaccaaga

SEQ ID NO: 538902 - RNA, 32 nt, Human
uugacaccagaugagccugaaucuaagcaaga

SEQ ID NO: 538903 - RNA, 32 nt, Human
uugacaccagccugggcaacauagugagaccu

SEQ ID NO: 538904 - RNA, 32 nt, Human
uugacaccagccugggcaacaugguaagaccc

SEQ ID NO: 538905 - RNA, 28 nt, Human
uugacaccaguggaagccucauccucag

SEQ ID NO: 538906 - RNA, 32 nt, Human
uugacacccaccaagcaaaaguuucagccugg

SEQ ID NO: 538907 - RNA, 32 nt, Human
uugacacccaggcuggagugcaguagcacaaa

SEQ ID NO: 538908 - RNA, 32 nt, Human
uugacacccaggcuggagugcaguggugccau

SEQ ID NO: 538909 - RNA, 32 nt, Human
uugacaccggaagaggacggaccuaagauggc

SEQ ID NO: 538910 - RNA, 32 nt, Human
uugacaccggauuuagcucuugucggccuucg

SEQ ID NO: 538911 - RNA, 32 nt, Human
uugacacggaguuucgcucuuguuguccaggc

SEQ ID NO: 538912 - RNA, 32 nt, Human
uugacacucccaccaucuucacccccaccuca

SEQ ID NO: 538913 - RNA, 32 nt, Human
uugacacucuguaucuagcuacucuagugggg

SEQ ID NO: 538914 - RNA, 32 nt, Human
uugacacugacagacccugccuggcaggccug

SEQ ID NO: 538915 - RNA, 32 nt, Human
uugacacuuacugcuagcucugcuuuuuauga

SEQ ID NO: 538916 - RNA, 32 nt, Human
uugacagaaaaucaccagaagccuagagaggc

SEQ ID NO: 538917 - RNA, 32 nt, Human
uugacagaucaucuuggacuucaggaaaugca

SEQ ID NO: 538918 - RNA, 32 nt, Human
uugacagcaccagccaagugaauaggucagag

SEQ ID NO: 538919 - RNA, 32 nt, Human
uugacagcaccuccagcucugcugcuucaaca

SEQ ID NO: 538920 - RNA, 32 nt, Human
uugacagcagagggcguucagggucccucagc

SEQ ID NO: 538921 - RNA, 32 nt, Human
uugacagcaucuuccucccuccuuuaauuaau

SEQ ID NO: 538922 - RNA, 32 nt, Human
uugacagccaugaccaugaaacucacaaggca

SEQ ID NO: 538923 - RNA, 32 nt, Human
uugacagcccccagugcgaaaggcugccagca

SEQ ID NO: 538924 - RNA, 32 nt, Human
uugacagcuaggcuggaggcucaugguuuccu

SEQ ID NO: 538925 - RNA, 32 nt, Human
uugacagcuuggugggaagggaagcacacucu

SEQ ID NO: 538926 - RNA, 32 nt, Human
uugacaggagguuggagggaaagccuuaagcu

SEQ ID NO: 538927 - RNA, 32 nt, Human
uugacaggauuugcuuguguuguuaaaacacu

SEQ ID NO: 538928 - RNA, 32 nt, Human
uugacaggcgccgccucgcccccgggcccuuu

SEQ ID NO: 538929 - RNA, 32 nt, Human
uugacaggcuggagacugagacaggaauugau

SEQ ID NO: 538930 - RNA, 32 nt, Human
uugacagguccugcuucccacuauccuuuucc

SEQ ID NO: 538931 - RNA, 22 nt, Human
uugacagucuaguuucagcaca

SEQ ID NO: 538932 - RNA, 32 nt, Human
uugacaguuguuaacccacuaggcuccuuuga

SEQ ID NO: 538933 - RNA, 32 nt, Human
uugacaguuguuuucuaaacuuccugcugagc

SEQ ID NO: 538934 - RNA, 32 nt, Human
uugacauaagacagcgugauguucuuuggugg

SEQ ID NO: 538935 - RNA, 32 nt, Human
uugacaucaaccugggcaacauggugaccucc

SEQ ID NO: 538936 - RNA, 32 nt, Human
uugacaucaagucgcugacuccugguggcaag

SEQ ID NO: 538937 - RNA, 32 nt, Human
uugacaucaguaguucaagaccagccuggcca

SEQ ID NO: 538938 - RNA, 32 nt, Human
uugacaucagucaggagcugggaguugagacc

SEQ ID NO: 538939 - RNA, 22 nt, Human
uugacaucgacuuucugugcca

SEQ ID NO: 538940 - RNA, 32 nt, Human
uugacaugcugugacccguuucaggcugccca

SEQ ID NO: 538941 - RNA, 32 nt, Human
uugacauggaguuucgcucuugucacccaggc

SEQ ID NO: 538942 - RNA, 32 nt, Human
uugacauguacaguauguuuucaugccguugu

SEQ ID NO: 538943 - RNA, 32 nt, Human
uugacaugugguucauagcuggugaacggugc

SEQ ID NO: 538944 - RNA, 32 nt, Human
uugacauuccuauauuggguuuaggucuaauu

SEQ ID NO: 538945 - RNA, 32 nt, Human
uugacauucuucacugucuguuguuuaccuac

SEQ ID NO: 538946 - RNA, 32 nt, Human
uugacauuucacccuucuuugaggcaugccuu

SEQ ID NO: 538947 - RNA, 32 nt, Human
uugaccaaaacacaguauaaaaacacuggcac

SEQ ID NO: 538948 - RNA, 31 nt, Human
uugaccaaagacaccugaacauuccuggaga

SEQ ID NO: 538949 - RNA, 32 nt, Human
uugaccaaaucccauggagaaaagacaucuca

SEQ ID NO: 538950 - RNA, 32 nt, Human
uugaccaacaugcugaaaccccaucucuauua

SEQ ID NO: 538951 - RNA, 32 nt, Human
uugaccaacauggagaaaccucguuucuacua

SEQ ID NO: 538952 - RNA, 22 nt, Human
uugaccaacauggugaaacccc

SEQ ID NO: 538953 - RNA, 32 nt, Human
uugaccaacauggugaaaccccaucucuacaa

SEQ ID NO: 538954 - RNA, 32 nt, Human
uugaccaaccaaaggaaacaucuuuugacuga

SEQ ID NO: 538955 - RNA, 32 nt, Human
uugaccacagccacuuuagaaaagcuuccugu

SEQ ID NO: 538956 - RNA, 32 nt, Human
uugaccacaguuucagcgaugccucaggucuc

SEQ ID NO: 538957 - RNA, 32 nt, Human
uugaccaccaguacuucuauaaugguagauug

SEQ ID NO: 538958 - RNA, 32 nt, Human
uugaccacugauuugaauuggcugaccgcaug

SEQ ID NO: 538959 - RNA, 20 nt, Human
uugaccagauacugaaggaa

SEQ ID NO: 538960 - RNA, 32 nt, Human
uugaccagaugaaaccucuccaggcaaguggc

SEQ ID NO: 538961 - RNA, 32 nt, Human
uugaccagauguuccaaaauaucugcauccac

SEQ ID NO: 538962 - RNA, 32 nt, Human
uugaccagcacucccucccaaccagagaauua

SEQ ID NO: 538963 - RNA, 32 nt, Human
uugaccaggagugucagcuuuuagaaggauca

SEQ ID NO: 538964 - RNA, 32 nt, Human
uugaccaggcuggagugaaguggugugauccc

SEQ ID NO: 538965 - RNA, 21 nt, Human
uugaccaggcuggagugcagu

SEQ ID NO: 538966 - RNA, 32 nt, Human
uugaccaggcuggagugcaguggugagaucug

SEQ ID NO: 538967 - RNA, 32 nt, Human
uugaccaggcuggucuugaacucuuggcaccc

SEQ ID NO: 538968 - RNA, 32 nt, Human
uugaccaggcuggucuugaacuuuugggcuca

SEQ ID NO: 538969 - RNA, 24 nt, Human
uugaccaggcuuggccuugggcua

SEQ ID NO: 538970 - RNA, 32 nt, Human
uugaccaucacuggcaggaagagcuaaagauc

SEQ ID NO: 538971 - RNA, 32 nt, Human
uugaccaucuggucccaggagcucaggaggag

SEQ ID NO: 538972 - RNA, 32 nt, Human
uugaccaugucuuccuaaccaggcccacacuu

SEQ ID NO: 538973 - RNA, 32 nt, Human
uugacccaagccugugaugacauggugcugau

SEQ ID NO: 538974 - RNA, 32 nt, Human
uugacccacucuccuaucuccagaccuuuacc

SEQ ID NO: 538975 - RNA, 32 nt, Human
uugacccagaccagucccaacgcccagugcgg

SEQ ID NO: 538976 - RNA, 32 nt, Human
uugacccagagccccauccugaugaccucaca

SEQ ID NO: 538977 - RNA, 32 nt, Human
uugacccagauugugugcccugugccaguggg

SEQ ID NO: 538978 - RNA, 32 nt, Human
uugacccagcuuccuucucuccuuuuaccuga

SEQ ID NO: 538979 - RNA, 32 nt, Human
uugacccaggaagcggagguugcagugagcca

SEQ ID NO: 538980 - RNA, 32 nt, Human
uugacccaggaggcagagguugcagugagcca

SEQ ID NO: 538981 - RNA, 32 nt, Human
uugacccaggaggcggagguugcggugacccu

SEQ ID NO: 538982 - RNA, 32 nt, Human
uugacccaggagguggaggucgcagugagccg

SEQ ID NO: 538983 - RNA, 32 nt, Human
uugacccaggaguucaagaccagccuggccaa

SEQ ID NO: 538984 - RNA, 32 nt, Human
uugacccauguacacauacuccuugaaccuaa

SEQ ID NO: 538985 - RNA, 32 nt, Human
uugaccccaggagacguagguuguggugagcu

SEQ ID NO: 538986 - RNA, 32 nt, Human
uugaccccaggaggcgaagauugcagugagcu

SEQ ID NO: 538987 - RNA, 32 nt, Human
uugaccccaggagguggacauugcagugagcc

SEQ ID NO: 538988 - RNA, 32 nt, Human
uugaccccaggaguucaagaccagccugggca

SEQ ID NO: 538989 - RNA, 32 nt, Human
uugaccccaggugguggagguugcagugagcc

SEQ ID NO: 538990 - RNA, 32 nt, Human
uugaccccaucuuuggaaguagcccuuuacca

SEQ ID NO: 538991 - RNA, 32 nt, Human
uugacccccaggcuggagugcaguggcacgau

SEQ ID NO: 538992 - RNA, 32 nt, Human
uugaccccgauaucuacauagaugcuaucggg

SEQ ID NO: 538993 - RNA, 32 nt, Human
uugaccccgggagguggaggcugcagugaguu

SEQ ID NO: 538994 - RNA, 32 nt, Human
uugaccccucagagagcuucagcccagaccug

SEQ ID NO: 538995 - RNA, 32 nt, Human
uugaccccuugcagcuguuggaaucucugcaa

SEQ ID NO: 538996 - RNA, 32 nt, Human
uugacccucuccugaaauuugccaucugacaa

SEQ ID NO: 538997 - RNA, 32 nt, Human
uugacccugaucaacaaugagcagaaacauca

SEQ ID NO: 538998 - RNA, 24 nt, Human
uugacccugauggggacccguagg

SEQ ID NO: 538999 - RNA, 32 nt, Human
uugacccugcauugcaaaacacagguucgggu

SEQ ID NO: 539000 - RNA, 32 nt, Human
uugacccuuccccucccugggaguacacugag

SEQ ID NO: 539001 - RNA, 32 nt, Human
uugaccgccuucucacugggccuguagugcgg

SEQ ID NO: 539002 - RNA, 23 nt, Human
uugaccgcucuuccuuuccugga

SEQ ID NO: 539003 - RNA, 32 nt, Human
uugaccgcuguucacuguccacgugaucaguu

SEQ ID NO: 539004 - RNA, 32 nt, Human
uugaccgggagacagagguugcagugagcuga

SEQ ID NO: 539005 - RNA, 32 nt, Human
uugaccguacucucacauguggcaaaauaugg

SEQ ID NO: 539006 - RNA, 32 nt, Human
uugaccguggcaaaguguacaguagauuuuca

SEQ ID NO: 539007 - RNA, 32 nt, Human
uugaccuacuuugguaguggaauagugaauac

SEQ ID NO: 539008 - RNA, 31 nt, Human
uugaccuagauaaauacacuuugagaaaucc

SEQ ID NO: 539009 - RNA, 32 nt, Human
uugaccuauaucuccccauuuccucuccuucc

SEQ ID NO: 539010 - RNA, 32 nt, Human
uugaccucagguaguccgccuuccucggccuc

SEQ ID NO: 539011 - RNA, 32 nt, Human
uugaccucaggugauccacccaccucagccuc

SEQ ID NO: 539012 - RNA, 32 nt, Human
uugaccucaggugauccacccaccucggccuc

SEQ ID NO: 539013 - RNA, 32 nt, Human
uugaccucaggugaucugcccaccucggccuc

SEQ ID NO: 539014 - RNA, 32 nt, Human
uugaccucauuuuccccaucugaaaagagagg

SEQ ID NO: 539015 - RNA, 32 nt, Human
uugaccucccaaagugccgggauuacaggcau

SEQ ID NO: 539016 - RNA, 32 nt, Human
uugaccucccaaagugccgggauugcaggcau

SEQ ID NO: 539017 - RNA, 32 nt, Human
uugaccucccaaagugcugggaugacaggcgu

SEQ ID NO: 539018 - RNA, 32 nt, Human
uugaccucccaaagugcugggauuacaggcau

SEQ ID NO: 539019 - RNA, 32 nt, Human
uugaccucccaaagugcugggauuacaggcgu

SEQ ID NO: 539020 - RNA, 32 nt, Human
uugaccucccaaagugcugggauuacagggga

SEQ ID NO: 539021 - RNA, 32 nt, Human
uugaccucccaaagugcugggauuacuagacg

SEQ ID NO: 539022 - RNA, 32 nt, Human
uugaccucccagacccaagugauccucccacc

SEQ ID NO: 539023 - RNA, 32 nt, Human
uugaccucccagagggcugaacucuuucaacu

SEQ ID NO: 539024 - RNA, 32 nt, Human
uugaccuccuaaauuguugggauuacaggugu

SEQ ID NO: 539025 - RNA, 32 nt, Human
uugaccuccuggcaaauugcugcgucuuucca

SEQ ID NO: 539026 - RNA, 32 nt, Human
uugaccucgggugauccacccaccucagccuc

SEQ ID NO: 539027 - RNA, 32 nt, Human
uugaccucuagaccccaagaugugaacagugc

SEQ ID NO: 539028 - RNA, 32 nt, Human
uugaccucuguccugggcuccugggccaggug

SEQ ID NO: 539029 - RNA, 32 nt, Human
uugaccugaccuggccccuucuugcugggccc

SEQ ID NO: 539030 - RNA, 32 nt, Human
uugaccugacuuuagaaccugaccucaaggau

SEQ ID NO: 539031 - RNA, 32 nt, Human
uugaccugcccacucuccacacugccucaccu

SEQ ID NO: 539032 - RNA, 31 nt, Human
uugaccugccuuuucugacuccgggacgagc

SEQ ID NO: 539033 - RNA, 32 nt, Human
uugaccugcgcaaugcagaggcugcagguagu

SEQ ID NO: 539034 - RNA, 32 nt, Human
uugaccugcuucugucacagcacugaucacac

SEQ ID NO: 539035 - RNA, 32 nt, Human
uugaccuggcaggcggagguugcagugagccg

SEQ ID NO: 539036 - RNA, 22 nt, Human
uugaccuggccucucccccaca

SEQ ID NO: 539037 - RNA, 29 nt, Human
uugaccuggcugcaucuuuccucagcucu

SEQ ID NO: 539038 - RNA, 32 nt, Human
uugaccuggcuggucucgaacuccugaacgca

SEQ ID NO: 539039 - RNA, 32 nt, Human
uugaccugggaggcggagauugcggugagccu

SEQ ID NO: 539040 - RNA, 32 nt, Human
uugaccugguggauguggcugcaguccagaga

SEQ ID NO: 539041 - RNA, 32 nt, Human
uugaccugguugcagaacauggcaggcaagca

SEQ ID NO: 539042 - RNA, 32 nt, Human
uugaccuuaugagaaacugcaugugggcuaug

SEQ ID NO: 539043 - RNA, 32 nt, Human
uugaccuucaguuuaagaaaaccccucuaaga

SEQ ID NO: 539044 - RNA, 32 nt, Human
uugaccuucccaagguuacucagcagcagaga

SEQ ID NO: 539045 - RNA, 32 nt, Human
uugaccuucucccagccuccugucuccuaccu

SEQ ID NO: 539046 - RNA, 22 nt, Human
uugaccuugauugacugucagg

SEQ ID NO: 539047 - RNA, 32 nt, Human
uugaccuuggcacacacugcagagccacaggg

SEQ ID NO: 539048 - RNA, 18 nt, Human
uugaccuuuuggggccuu

SEQ ID NO: 539049 - RNA, 32 nt, Human
uugacgaaugcacagaggcgcuggcagaacca

SEQ ID NO: 539050 - RNA, 32 nt, Human
uugacgaccaccaugacugagaucacugcuga

SEQ ID NO: 539051 - RNA, 32 nt, Human
uugacgaggucugagcgaccauggaccggccg

SEQ ID NO: 539052 - RNA, 32 nt, Human
uugacgcagccccuacacuccaucccaaccaa

SEQ ID NO: 539053 - RNA, 32 nt, Human
uugacgccaagaguucgagaccagccugggca

SEQ ID NO: 539054 - RNA, 32 nt, Human
uugacgcucugggccgccaccuccgcggaccc

SEQ ID NO: 539055 - RNA, 32 nt, Human
uugacggcguguguuggucccaucucucagac

SEQ ID NO: 539056 - RNA, 32 nt, Human
uugacggcucuggacccaggacagacagacag

SEQ ID NO: 539057 - RNA, 32 nt, Human
uugacggcuuugccuaggucccuccgcccgua

SEQ ID NO: 539058 - RNA, 32 nt, Human
uugacgggaagcggagguugcagugagccgag

SEQ ID NO: 539059 - RNA, 32 nt, Human
uugacgggcacugcgggugaggaugagaaguc

SEQ ID NO: 539060 - RNA, 32 nt, Human
uugacgggccuggaggguauuaaagagacaca

SEQ ID NO: 539061 - RNA, 32 nt, Human
uugacgggcugucuuggcucuggaauucaugc

SEQ ID NO: 539062 - RNA, 32 nt, Human
uugacgguggugcugaggcaugaaaggcuagu

SEQ ID NO: 539063 - RNA, 32 nt, Human
uugacgucaggaguucgagaccagccuggcca

SEQ ID NO: 539064 - RNA, 32 nt, Human
uugacgucagugugggguuacucagcuaaggc

SEQ ID NO: 539065 - RNA, 32 nt, Human
uugacguccugggacacaaagcugaauuggga

SEQ ID NO: 539066 - RNA, 32 nt, Human
uugacguggagcugcucaacuuagagugaagg

SEQ ID NO: 539067 - RNA, 27 nt, Human
uugacguucaauaaaacuguugaaucu

SEQ ID NO: 539068 - RNA, 32 nt, Human
uugacguuguguccuccuccccuggacaaucu

SEQ ID NO: 539069 - RNA, 32 nt, Human
uugacguuuuaaacuccuaggcccaggaugag

SEQ ID NO: 539070 - RNA, 32 nt, Human
uugacguuuuggugggcuggccgaagaaggag

SEQ ID NO: 539071 - RNA, 32 nt, Human
uugacuaaacuuuuauccuuccuuuaacuuaa

SEQ ID NO: 539072 - RNA, 32 nt, Human
uugacuaaucuugccuggguuuguguaggucu

SEQ ID NO: 539073 - RNA, 32 nt, Human
uugacuacaagugcucacagacuagaacuuaa

SEQ ID NO: 539074 - RNA, 32 nt, Human
uugacuacaagugggccgugcagcugguuccu

SEQ ID NO: 539075 - RNA, 32 nt, Human
uugacuacagaggauuuggggacucuacaggu

SEQ ID NO: 539076 - RNA, 32 nt, Human
uugacuagaaacugccuuuuucuccacuucau

SEQ ID NO: 539077 - RNA, 32 nt, Human
uugacuagagguuaccaccauugugaucaaga

SEQ ID NO: 539078 - RNA, 32 nt, Human
uugacuagcccagcucugggguccccauguaa

SEQ ID NO: 539079 - RNA, 32 nt, Human
uugacuagguaguggcgaaguucuggaagcac

SEQ ID NO: 539080 - RNA, 32 nt, Human
uugacuagguuaucaaaauuaaccucaccaau

SEQ ID NO: 539081 - RNA, 32 nt, Human
uugacuagucaaggacugggaacgugccaggg

SEQ ID NO: 539082 - RNA, 32 nt, Human
uugacuauuuaaaggauaaaguaguauuuaau

SEQ ID NO: 539083 - RNA, 32 nt, Human
uugacuauuuguguagcaaacagccucuuagg

SEQ ID NO: 539084 - RNA, 32 nt, Human
uugacucaaaauaucuaugaaccaaaggauau

SEQ ID NO: 539085 - RNA, 32 nt, Human
uugacucaaagaggaaggauggaaaacaucuc

SEQ ID NO: 539086 - RNA, 32 nt, Human
uugacucacuacaaccuccgccucccagguuc

SEQ ID NO: 539087 - RNA, 32 nt, Human
uugacucacugcaacaucugccucccggguuc

SEQ ID NO: 539088 - RNA, 32 nt, Human
uugacucacugcaaccuccaccucccagguuc

SEQ ID NO: 539089 - RNA, 32 nt, Human
uugacucacugcaaccuccgccucacagcuuc

SEQ ID NO: 539090 - RNA, 32 nt, Human
uugacucacugcaaccuccgccucccagguuc

SEQ ID NO: 539091 - RNA, 32 nt, Human
uugacucacugcaaccuccgccuccuggguuc

SEQ ID NO: 539092 - RNA, 32 nt, Human
uugacucacugcaaccucugccucccagguuu

SEQ ID NO: 539093 - RNA, 32 nt, Human
uugacucacugcaaccucugccucucggguuc

SEQ ID NO: 539094 - RNA, 32 nt, Human
uugacucacugcaaucuccaccucccacaggu

SEQ ID NO: 539095 - RNA, 32 nt, Human
uugacucacugcaauucugccuccuggguuca

SEQ ID NO: 539096 - RNA, 32 nt, Human
uugacucacugcagccucaaccucccaggcuc

SEQ ID NO: 539097 - RNA, 32 nt, Human
uugacucaguacuauuucuuuucacuuugaaa

SEQ ID NO: 539098 - RNA, 32 nt, Human
uugacucagugaugcagaaccuuucagaguua

SEQ ID NO: 539099 - RNA, 32 nt, Human
uugacucagugcucccuuccucuccucuccuu

SEQ ID NO: 539100 - RNA, 32 nt, Human
uugacucauuggacuguuaugaggcuugugcc

SEQ ID NO: 539101 - RNA, 32 nt, Human
uugacuccaccaggagcggcuacguuguaacc

SEQ ID NO: 539102 - RNA, 32 nt, Human
uugacuccagagacucaggauaggagggcagc

SEQ ID NO: 539103 - RNA, 32 nt, Human
uugacuccaggaggcgcaggcugcagugagcu

SEQ ID NO: 539104 - RNA, 32 nt, Human
uugacuccaggcugggcgauuccgaugcugac

SEQ ID NO: 539105 - RNA, 32 nt, Human
uugacuccaguauugggcaggugccuacagac

SEQ ID NO: 539106 - RNA, 32 nt, Human
uugacuccaugcuucuuagccugguggcagug

SEQ ID NO: 539107 - RNA, 32 nt, Human
uugacuccuccagggcccgggcuaagggcaca

SEQ ID NO: 539108 - RNA, 32 nt, Human
uugacucgcugcagucuccaccuccaggauuc

SEQ ID NO: 539109 - RNA, 32 nt, Human
uugacucgcugcuggggguccugcucuucguc

SEQ ID NO: 539110 - RNA, 32 nt, Human
uugacucucucucuucccgugccuguacaaag

SEQ ID NO: 539111 - RNA, 32 nt, Human
uugacucuugacuucucuggugcaagaccuca

SEQ ID NO: 539112 - RNA, 32 nt, Human
uugacugaaaguaccaggaagauacugaauac

SEQ ID NO: 539113 - RNA, 32 nt, Human
uugacugagcucaucagugaaauguugaauag

SEQ ID NO: 539114 - RNA, 32 nt, Human
uugacugaugaaugaagagcguuucuaauaaa

SEQ ID NO: 539115 - RNA, 32 nt, Human
uugacugaugauuuuccuuuuucuucgcugga

SEQ ID NO: 539116 - RNA, 21 nt, Human
uugacugccaagguuuccaag

SEQ ID NO: 539117 - RNA, 32 nt, Human
uugacugccacauauggaccccaaaagaucuc

SEQ ID NO: 539118 - RNA, 32 nt, Human
uugacugccaggcugggugcaguggcucacac

SEQ ID NO: 539119 - RNA, 32 nt, Human
uugacugccauauuuuccuuccuuccuuccuu

SEQ ID NO: 539120 - RNA, 24 nt, Human
uugacugccugggagguccccaag

SEQ ID NO: 539121 - RNA, 32 nt, Human
uugacugcucuguuugggugggagaagauucu

SEQ ID NO: 539122 - RNA, 32 nt, Human
uugacuggaccacugccaccucuugguagcca

SEQ ID NO: 539123 - RNA, 32 nt, Human
uugacuggaccgcugccaccucuugguagcca

SEQ ID NO: 539124 - RNA, 32 nt, Human
uugacuggaggcggagguugcagugagccgag

SEQ ID NO: 539125 - RNA, 32 nt, Human
uugacuggcaaaacaggagcagggggagccca

SEQ ID NO: 539126 - RNA, 32 nt, Human
uugacugggaaugggucaaaggcggugcagga

SEQ ID NO: 539127 - RNA, 32 nt, Human
uugacugggcuguggaggugggcaugugggcc

SEQ ID NO: 539128 - RNA, 32 nt, Human
uugacuguagccacagcugcuguucucaggac

SEQ ID NO: 539129 - RNA, 32 nt, Human
uugacuguauucacauaaauggugcuaaaaca

SEQ ID NO: 539130 - RNA, 32 nt, Human
uugacugucuagccacucccucccagaaaaac

SEQ ID NO: 539131 - RNA, 32 nt, Human
uugacuguuauuucuuuucuuccugcuuuccu

SEQ ID NO: 539132 - RNA, 32 nt, Human
uugacuguuccacagcuacuucccaggacccc

SEQ ID NO: 539133 - RNA, 32 nt, Human
uugacuuaaaaagaggaguggggaauauucug

SEQ ID NO: 539134 - RNA, 32 nt, Human
uugacuuagaagcaauagggggcagcaggcca

SEQ ID NO: 539135 - RNA, 32 nt, Human
uugacuuauacaacauagucagucuagaguug

SEQ ID NO: 539136 - RNA, 26 nt, Human
uugacuuauugagaaauaaugcagug

SEQ ID NO: 539137 - RNA, 32 nt, Human
uugacuucaagaugccucuucuaccucuucca

SEQ ID NO: 539138 - RNA, 32 nt, Human
uugacuucacaguaaucaguaguuuuauaggu

SEQ ID NO: 539139 - RNA, 32 nt, Human
uugacuucauccugucauuccagccugggguc

SEQ ID NO: 539140 - RNA, 32 nt, Human
uugacuucaugaucugcauccuaggcacacug

SEQ ID NO: 539141 - RNA, 32 nt, Human
uugacuuccaauggcaaaccugggugaucggg

SEQ ID NO: 539142 - RNA, 32 nt, Human
uugacuucccaaagugcugggauuacaggcgg

SEQ ID NO: 539143 - RNA, 32 nt, Human
uugacuucccaaagugcugggauuaugggcgg

SEQ ID NO: 539144 - RNA, 32 nt, Human
uugacuuccccuucagcuucagaccccuuccc

SEQ ID NO: 539145 - RNA, 32 nt, Human
uugacuuccucucuuuuuauuuggaggcacuu

SEQ ID NO: 539146 - RNA, 32 nt, Human
uugacuuccucuuccuagacuugaggccuuuu

SEQ ID NO: 539147 - RNA, 32 nt, Human
uugacuuccucuuccuucugauucugccugaa

SEQ ID NO: 539148 - RNA, 32 nt, Human
uugacuuccucuuuuccuaauugaauaaccug

SEQ ID NO: 539149 - RNA, 32 nt, Human
uugacuucucaaaaucaauauacuugacuucc

SEQ ID NO: 539150 - RNA, 32 nt, Human
uugacuucuugugcaacugcucaggccuugau

SEQ ID NO: 539151 - RNA, 32 nt, Human
uugacuucuuuucuaaauauuuacauggauuu

SEQ ID NO: 539152 - RNA, 19 nt, Human
uugacuugaggcggcacag

SEQ ID NO: 539153 - RNA, 23 nt, Human
uugacuugcaguuccgggcugug

SEQ ID NO: 539154 - RNA, 21 nt, Human
uugacuuggauguugugggug

SEQ ID NO: 539155 - RNA, 32 nt, Human
uugacuugucuuuuuaaaugcuuuaucuuuuu

SEQ ID NO: 539156 - RNA, 32 nt, Human
uugacuugugggcucccacaggagucauggug

SEQ ID NO: 539157 - RNA, 32 nt, Human
uugacuuuaccaaaaccgucaggauuugaauc

SEQ ID NO: 539158 - RNA, 32 nt, Human
uugacuuucacaccucauauaaucagaucuau

SEQ ID NO: 539159 - RNA, 32 nt, Human
uugacuuucucuucuccucgauccucaugguc

SEQ ID NO: 539160 - RNA, 32 nt, Human
uugacuuucugugagcccccagcgaggggagg

SEQ ID NO: 539161 - RNA, 32 nt, Human
uugacuuugcaauaacguggcagguaucugau

SEQ ID NO: 539162 - RNA, 32 nt, Human
uugacuuugcagcugguugagaacagguugga

SEQ ID NO: 539163 - RNA, 32 nt, Human
uugacuuugccaccgucucucuucuggguucc

SEQ ID NO: 539164 - RNA, 32 nt, Human
uugacuuuggggaaagaaaaggaagcugcagg

SEQ ID NO: 539165 - RNA, 32 nt, Human
uugacuuuucuuucuaguccuggggccuagau

SEQ ID NO: 539166 - RNA, 32 nt, Human
uugacuuuuugcagcucggcugugccucaucu

SEQ ID NO: 539167 - RNA, 32 nt, Human
uugagaaaacauuagaacaaauuuuauuauuu

SEQ ID NO: 539168 - RNA, 32 nt, Human
uugagaaaaggcagaguucucagguccuagga

SEQ ID NO: 539169 - RNA, 32 nt, Human
uugagaaacuuaggacagaagccuaccucauc

SEQ ID NO: 539170 - RNA, 32 nt, Human
uugagaaaggaugcaccaaggccaggcuuacc

SEQ ID NO: 539171 - RNA, 32 nt, Human
uugagaaagugagauguaggauucaaggaaga

SEQ ID NO: 539172 - RNA, 32 nt, Human
uugagaacaaauguacaaauauaaagaaagua

SEQ ID NO: 539173 - RNA, 32 nt, Human
uugagaacaacaaaagaccuuucauuauuuac

SEQ ID NO: 539174 - RNA, 32 nt, Human
uugagaacaaccugggcaacauggcgaaaccc

SEQ ID NO: 539175 - RNA, 32 nt, Human
uugagaacaacucaugaucacaauucauaaaa

SEQ ID NO: 539176 - RNA, 32 nt, Human
uugagaacagccuggccaacacggugaaaccc

SEQ ID NO: 539177 - RNA, 32 nt, Human
uugagaacagccuggccaacauagugaaacuc

SEQ ID NO: 539178 - RNA, 32 nt, Human
uugagaacagccuggccaacauggugaaaccc

SEQ ID NO: 539179 - RNA, 32 nt, Human
uugagaacagccuggccaacauggugaaaccu

SEQ ID NO: 539180 - RNA, 32 nt, Human
uugagaacagccuggccaacauggugaaacuc

SEQ ID NO: 539181 - RNA, 32 nt, Human
uugagaacagccuggccaacgugaugaaaccc

SEQ ID NO: 539182 - RNA, 32 nt, Human
uugagaacaggccagucuugaccccaauacag

SEQ ID NO: 539183 - RNA, 32 nt, Human
uugagaaccaaaaucaagaggaacagaaaucu

SEQ ID NO: 539184 - RNA, 32 nt, Human
uugagaacccauguauggguugcagugagccg

SEQ ID NO: 539185 - RNA, 32 nt, Human
uugagaaccccaagacagagacagugagccag

SEQ ID NO: 539186 - RNA, 32 nt, Human
uugagaacccccagaccuacauaaggggaacc

SEQ ID NO: 539187 - RNA, 32 nt, Human
uugagaacguuauuuugcuaguucuuaagguu

SEQ ID NO: 539188 - RNA, 32 nt, Human
uugagaagacuccugggcuucagccucuccca

SEQ ID NO: 539189 - RNA, 32 nt, Human
uugagaagaggaagaagauggaagcugauggg

SEQ ID NO: 539190 - RNA, 32 nt, Human
uugagaagcauaacuuuaugacaacuuagggg

SEQ ID NO: 539191 - RNA, 32 nt, Human
uugagaagcguuuuuaaccuguuuuguuaaug

SEQ ID NO: 539192 - RNA, 32 nt, Human
uugagaagcuaagaugguggauggugcagaaa

SEQ ID NO: 539193 - RNA, 32 nt, Human
uugagaagcuucucacaagugaugcacuuuaa

SEQ ID NO: 539194 - RNA, 32 nt, Human
uugagaaggaaagaagccuggagcagccucuc

SEQ ID NO: 539195 - RNA, 32 nt, Human
uugagaaggagagaaaaagguggcaggaauuu

SEQ ID NO: 539196 - RNA, 32 nt, Human
uugagaaggagagaaagugggugagaugcugg

SEQ ID NO: 539197 - RNA, 32 nt, Human
uugagaaggcguuucgcucuuguugcccaggc

SEQ ID NO: 539198 - RNA, 32 nt, Human
uugagaagggagggaggaagacaggaaggaag

SEQ ID NO: 539199 - RNA, 32 nt, Human
uugagaaggugaagcaggggaguucugaagag

SEQ ID NO: 539200 - RNA, 32 nt, Human
uugagaagugucuguucauguccuuugcccau

SEQ ID NO: 539201 - RNA, 32 nt, Human
uugagaauaggaguucaagaccagccugggca

SEQ ID NO: 539202 - RNA, 32 nt, Human
uugagaaucacuuguuaguucuugguaggaau

SEQ ID NO: 539203 - RNA, 32 nt, Human
uugagaaugcccugcccuguguggaagccuga

SEQ ID NO: 539204 - RNA, 32 nt, Human
uugagaauggguuuccaggaaacccguugucu

SEQ ID NO: 539205 - RNA, 32 nt, Human
uugagaauucuuucccccucuccugguuucca

SEQ ID NO: 539206 - RNA, 32 nt, Human
uugagacaaacagugagcgggcaccaacaggc

SEQ ID NO: 539207 - RNA, 32 nt, Human
uugagacaaaguuucgcucuuguugcccaggc

SEQ ID NO: 539208 - RNA, 32 nt, Human
uugagacaagggaggcaggggacuuaugcauc

SEQ ID NO: 539209 - RNA, 31 nt, Human
uugagacaaguguucaaacagaaagacgcuu

SEQ ID NO: 539210 - RNA, 32 nt, Human
uugagacacaguuucgcucuuauugcccaggc

SEQ ID NO: 539211 - RNA, 32 nt, Human
uugagacacaguuugcucugucacccaggcug

SEQ ID NO: 539212 - RNA, 32 nt, Human
uugagacaccuacaggguguagaaaagaagaa

SEQ ID NO: 539213 - RNA, 32 nt, Human
uugagacacugucaagggaauggucuuccuua

SEQ ID NO: 539214 - RNA, 32 nt, Human
uugagacagaauuuugcucuuguugcccaggc

SEQ ID NO: 539215 - RNA, 32 nt, Human
uugagacagagucucacucuuguugcccaagc

SEQ ID NO: 539216 - RNA, 32 nt, Human
uugagacagagucugguucuguuucccaggcu

SEQ ID NO: 539217 - RNA, 32 nt, Human
uugagacagaguuucacucuuguugcccacgc

SEQ ID NO: 539218 - RNA, 32 nt, Human
uugagacagaguuucacucuuguugcccaggc

SEQ ID NO: 539219 - RNA, 29 nt, Human
uugagacagaguuucacucuuguugccug

SEQ ID NO: 539220 - RNA, 32 nt, Human
uugagacagaguuucacucuuguuguccaguc

SEQ ID NO: 539221 - RNA, 32 nt, Human
uugagacagaguuucacuuuuguugcccaggc

SEQ ID NO: 539222 - RNA, 32 nt, Human
uugagacagaguuucauucuuguugcccaggg

SEQ ID NO: 539223 - RNA, 32 nt, Human
uugagacagaguuucgcacuucuugcccaggc

SEQ ID NO: 539224 - RNA, 32 nt, Human
uugagacagaguuucgcucuaguugcccacac

SEQ ID NO: 539225 - RNA, 32 nt, Human
uugagacagaguuucgcucuugucacccaggc

SEQ ID NO: 539226 - RNA, 32 nt, Human
uugagacagaguuucgcucuuguugcccaagc

SEQ ID NO: 539227 - RNA, 32 nt, Human
uugagacagaguuucgcucuuguugcccagcc

SEQ ID NO: 539228 - RNA, 32 nt, Human
uugagacagaguuucgcucuuguugcccaggc

SEQ ID NO: 539229 - RNA, 32 nt, Human
uugagacagaguuucgcucuuguugcugaggc

SEQ ID NO: 539230 - RNA, 32 nt, Human
uugagacagaguuucgcuuugucgcccaggcu

SEQ ID NO: 539231 - RNA, 32 nt, Human
uugagacagaguuucgcuuuuguugcccgggc

SEQ ID NO: 539232 - RNA, 32 nt, Human
uugagacagaguuuggcucuuguugcccaggc

SEQ ID NO: 539233 - RNA, 32 nt, Human
uugagacagaguuuugcccuuguugcccaggc

SEQ ID NO: 539234 - RNA, 32 nt, Human
uugagacagaguuuugcucuugucacccaggc

SEQ ID NO: 539235 - RNA, 32 nt, Human
uugagacagaguuuugcucuugucaccuaggc

SEQ ID NO: 539236 - RNA, 32 nt, Human
uugagacagaguuuugcucuuguugcccaggc

SEQ ID NO: 539237 - RNA, 32 nt, Human
uugagacagaguuuugcucuuguugcccaggu

SEQ ID NO: 539238 - RNA, 32 nt, Human
uugagacagaguuuugcucuuguuguccaggc

SEQ ID NO: 539239 - RNA, 32 nt, Human
uugagacagcacagcagccacuccaacaccag

SEQ ID NO: 539240 - RNA, 32 nt, Human
uugagacagcauucccaggaacaaaggcuggg

SEQ ID NO: 539241 - RNA, 32 nt, Human
uugagacagcgggagagcagagcacuggugcc

SEQ ID NO: 539242 - RNA, 32 nt, Human
uugagacaggagaccuggcacuggaugcagaa

SEQ ID NO: 539243 - RNA, 32 nt, Human
uugagacaggccuggccaaccuggugacucua

SEQ ID NO: 539244 - RNA, 32 nt, Human
uugagacaggguuucgcuguguugcuccagcu

SEQ ID NO: 539245 - RNA, 32 nt, Human
uugagacaggguuuugcucuuguugcccagcc

SEQ ID NO: 539246 - RNA, 32 nt, Human
uugagacagugcacaugaacugucuuuuaaug

SEQ ID NO: 539247 - RNA, 32 nt, Human
uugagacaguggguuccucagguccaacaaaa

SEQ ID NO: 539248 - RNA, 32 nt, Human
uugagaccaacaugggcaacauggugaaacac

SEQ ID NO: 539249 - RNA, 32 nt, Human
uugagaccaaccuagucaacauggugaaaccc

SEQ ID NO: 539250 - RNA, 32 nt, Human
uugagaccaaccuggccaacacagugagaccc

SEQ ID NO: 539251 - RNA, 32 nt, Human
uugagaccaaccuggccaacaugauaaaaccc

SEQ ID NO: 539252 - RNA, 32 nt, Human
uugagaccaaccuggccaacauggugaaaccc

SEQ ID NO: 539253 - RNA, 32 nt, Human
uugagaccaaccuggccaacauggugaaaccu

SEQ ID NO: 539254 - RNA, 32 nt, Human
uugagaccaaccuggccaacauguugaaaccu

SEQ ID NO: 539255 - RNA, 32 nt, Human
uugagaccaaccugguuaacauggugaaaccc

SEQ ID NO: 539256 - RNA, 32 nt, Human
uugagaccaacuuggccaacauggugaaaccc

SEQ ID NO: 539257 - RNA, 32 nt, Human
uugagaccaagaguucaagaccagccuggcca

SEQ ID NO: 539258 - RNA, 32 nt, Human
uugagaccacagaaguuauggaagacaggcag

SEQ ID NO: 539259 - RNA, 32 nt, Human
uugagaccacccuggccaacauggugaaaccc

SEQ ID NO: 539260 - RNA, 32 nt, Human
uugagaccacccuggccaacauggugaaaccu

SEQ ID NO: 539261 - RNA, 32 nt, Human
uugagaccagacugggcaacauggugagacuc

SEQ ID NO: 539262 - RNA, 32 nt, Human
uugagaccagcaugaccaacauggcgaaaccc

SEQ ID NO: 539263 - RNA, 32 nt, Human
uugagaccagccaggccaacauggugaaacuu

SEQ ID NO: 539264 - RNA, 32 nt, Human
uugagaccagcccaggcaacauggugaaaccc

SEQ ID NO: 539265 - RNA, 32 nt, Human
uugagaccagcccggacaacauggcgaaaccu

SEQ ID NO: 539266 - RNA, 32 nt, Human
uugagaccagcccggccaacauggugaaaccc

SEQ ID NO: 539267 - RNA, 32 nt, Human
uugagaccagccgggccaacauggugcaaccu

SEQ ID NO: 539268 - RNA, 32 nt, Human
uugagaccagccuagacaacauggugaaaccu

SEQ ID NO: 539269 - RNA, 32 nt, Human
uugagaccagccuagccaacaugcugaaacuc

SEQ ID NO: 539270 - RNA, 32 nt, Human
uugagaccagccuagccaacauggugaaaucc

SEQ ID NO: 539271 - RNA, 32 nt, Human
uugagaccagccuaggcaacacagugaaaccc

SEQ ID NO: 539272 - RNA, 32 nt, Human
uugagaccagccuaggugacaaagugagaccc

SEQ ID NO: 539273 - RNA, 32 nt, Human
uugagaccagccucaucaacacagugaaacuc

SEQ ID NO: 539274 - RNA, 32 nt, Human
uugagaccagccuccuggccaacauggugaaa

SEQ ID NO: 539275 - RNA, 32 nt, Human
uugagaccagccucgccaacauggugaaaccc

SEQ ID NO: 539276 - RNA, 32 nt, Human
uugagaccagccucgccaacauggugagaccc

SEQ ID NO: 539277 - RNA, 32 nt, Human
uugagaccagccucggcaacauggcaaaaucu

SEQ ID NO: 539278 - RNA, 32 nt, Human
uugagaccagccugaacaacauggugaaaccc

SEQ ID NO: 539279 - RNA, 32 nt, Human
uugagaccagccugacauggugaaaccccauc

SEQ ID NO: 539280 - RNA, 32 nt, Human
uugagaccagccugaccaaaauggugaaaccc

SEQ ID NO: 539281 - RNA, 32 nt, Human
uugagaccagccugaccaaacauggcgaaacc

SEQ ID NO: 539282 - RNA, 32 nt, Human
uugagaccagccugaccaacauggagaaaccc

SEQ ID NO: 539283 - RNA, 32 nt, Human
uugagaccagccugaccaacauggagaaaccu

SEQ ID NO: 539284 - RNA, 32 nt, Human
uugagaccagccugaccaacauggcaaaaccc

SEQ ID NO: 539285 - RNA, 32 nt, Human
uugagaccagccugaccaacauggugaaaccc

SEQ ID NO: 539286 - RNA, 32 nt, Human
uugagaccagccugaccaacauggugaaaccu

SEQ ID NO: 539287 - RNA, 32 nt, Human
uugagaccagccugaccaacauggugaaacuc

SEQ ID NO: 539288 - RNA, 32 nt, Human
uugagaccagccugaccaacauggugaaaucc

SEQ ID NO: 539289 - RNA, 32 nt, Human
uugagaccagccugaccaacauggugaaauga

SEQ ID NO: 539290 - RNA, 32 nt, Human
uugagaccagccugaccaacguggugaaaccc

SEQ ID NO: 539291 - RNA, 32 nt, Human
uugagaccagccugaccaacguuaaguaaccc

SEQ ID NO: 539292 - RNA, 32 nt, Human
uugagaccagccugaccaagguggugaaaccc

SEQ ID NO: 539293 - RNA, 32 nt, Human
uugagaccagccugaccaucauggugaaaccu

SEQ ID NO: 539294 - RNA, 32 nt, Human
uugagaccagccugacuaacacagugaaaccc

SEQ ID NO: 539295 - RNA, 23 nt, Human
uugagaccagccugagcaacaug

SEQ ID NO: 539296 - RNA, 32 nt, Human
uugagaccagccugagcaacauggcgaaaccu

SEQ ID NO: 539297 - RNA, 32 nt, Human
uugagaccagccugagcaauguggugaaaccc

SEQ ID NO: 539298 - RNA, 32 nt, Human
uugagaccagccugagugacauagugagacuu

SEQ ID NO: 539299 - RNA, 32 nt, Human
uugagaccagccugaucaacauggugaaaccc

SEQ ID NO: 539300 - RNA, 32 nt, Human
uugagaccagccugaucaacguggugaaaccu

SEQ ID NO: 539301 - RNA, 32 nt, Human
uugagaccagccugcccaacauggugaaaccc

SEQ ID NO: 539302 - RNA, 32 nt, Human
uugagaccagccuggacaacacagugagaccu

SEQ ID NO: 539303 - RNA, 32 nt, Human
uugagaccagccuggacaacaugggaaaaccc

SEQ ID NO: 539304 - RNA, 32 nt, Human
uugagaccagccuggacaacauggugaaaccc

SEQ ID NO: 539305 - RNA, 32 nt, Human
uugagaccagccuggcaaacauggcaaaacug

SEQ ID NO: 539306 - RNA, 32 nt, Human
uugagaccagccuggcaaacauggugaaaccc

SEQ ID NO: 539307 - RNA, 32 nt, Human
uugagaccagccuggccaaaauggugaaacuc

SEQ ID NO: 539308 - RNA, 32 nt, Human
uugagaccagccuggccaaauggugaaacccc

SEQ ID NO: 539309 - RNA, 32 nt, Human
uugagaccagccuggccaacacaguaaacccu

SEQ ID NO: 539310 - RNA, 32 nt, Human
uugagaccagccuggccaacacggugaaaccc

SEQ ID NO: 539311 - RNA, 32 nt, Human
uugagaccagccuggccaacagggugaaaccc

SEQ ID NO: 539312 - RNA, 32 nt, Human
uugagaccagccuggccaacauagugaaaccc

SEQ ID NO: 539313 - RNA, 32 nt, Human
uugagaccagccuggccaacauauagugaaac

SEQ ID NO: 539314 - RNA, 23 nt, Human
uugagaccagccuggccaacaug

SEQ ID NO: 539315 - RNA, 32 nt, Human
uugagaccagccuggccaacaugaugaaaccc

SEQ ID NO: 539316 - RNA, 32 nt, Human
uugagaccagccuggccaacaugaugaaaugu

SEQ ID NO: 539317 - RNA, 32 nt, Human
uugagaccagccuggccaacaugcugaaaccc

SEQ ID NO: 539318 - RNA, 32 nt, Human
uugagaccagccuggccaacauggagaaaccc

SEQ ID NO: 539319 - RNA, 32 nt, Human
uugagaccagccuggccaacauggcaaaaacc

SEQ ID NO: 539320 - RNA, 32 nt, Human
uugagaccagccuggccaacauggcaaaacca

SEQ ID NO: 539321 - RNA, 32 nt, Human
uugagaccagccuggccaacauggcaaaaccc

SEQ ID NO: 539322 - RNA, 32 nt, Human
uugagaccagccuggccaacauggcaaaaccu

SEQ ID NO: 539323 - RNA, 32 nt, Human
uugagaccagccuggccaacauggcgaaaccc

SEQ ID NO: 539324 - RNA, 32 nt, Human
uugagaccagccuggccaacauggcgaaaccu

SEQ ID NO: 539325 - RNA, 32 nt, Human
uugagaccagccuggccaacauggcgagaccc

SEQ ID NO: 539326 - RNA, 32 nt, Human
uugagaccagccuggccaacauggcggaaccc

SEQ ID NO: 539327 - RNA, 32 nt, Human
uugagaccagccuggccaacaugguaaaacac

SEQ ID NO: 539328 - RNA, 32 nt, Human
uugagaccagccuggccaacaugguaaaaccc

SEQ ID NO: 539329 - RNA, 32 nt, Human
uugagaccagccuggccaacaugguaaaacgc

SEQ ID NO: 539330 - RNA, 32 nt, Human
uugagaccagccuggccaacaugguaaaaucc

SEQ ID NO: 539331 - RNA, 32 nt, Human
uugagaccagccuggccaacauggugaaacac

SEQ ID NO: 539332 - RNA, 32 nt, Human
uugagaccagccuggccaacauggugaaaccc

SEQ ID NO: 539333 - RNA, 32 nt, Human
uugagaccagccuggccaacauggugaaaccg

SEQ ID NO: 539334 - RNA, 32 nt, Human
uugagaccagccuggccaacauggugaaaccu

SEQ ID NO: 539335 - RNA, 32 nt, Human
uugagaccagccuggccaacauggugaaaucc

SEQ ID NO: 539336 - RNA, 32 nt, Human
uugagaccagccuggccaacauggugaaaucu

SEQ ID NO: 539337 - RNA, 32 nt, Human
uugagaccagccuggccaacauggugaagcuc

SEQ ID NO: 539338 - RNA, 32 nt, Human
uugagaccagccuggccaacauggugagaccc

SEQ ID NO: 539339 - RNA, 32 nt, Human
uugagaccagccuggccaacauggugauaucu

SEQ ID NO: 539340 - RNA, 32 nt, Human
uugagaccagccuggccaacaugguggaaccc

SEQ ID NO: 539341 - RNA, 32 nt, Human
uugagaccagccuggccaaccaacauggugaa

SEQ ID NO: 539342 - RNA, 32 nt, Human
uugagaccagccuggccaacguagugaaaccc

SEQ ID NO: 539343 - RNA, 32 nt, Human
uugagaccagccuggccaacguggcaaaaccc

SEQ ID NO: 539344 - RNA, 32 nt, Human
uugagaccagccuggccaacguggcaaaaccu

SEQ ID NO: 539345 - RNA, 32 nt, Human
uugagaccagccuggccaacguggugaaaccc

SEQ ID NO: 539346 - RNA, 32 nt, Human
uugagaccagccuggccaagauggugaaaccc

SEQ ID NO: 539347 - RNA, 32 nt, Human
uugagaccagccuggccaauauggcaaaaccc

SEQ ID NO: 539348 - RNA, 32 nt, Human
uugagaccagccuggccaauauggcgaaaccc

SEQ ID NO: 539349 - RNA, 32 nt, Human
uugagaccagccuggccaauauggugaaacca

SEQ ID NO: 539350 - RNA, 32 nt, Human
uugagaccagccuggccaauauggugaaaccc

SEQ ID NO: 539351 - RNA, 32 nt, Human
uugagaccagccuggccaauguggugaaaccc

SEQ ID NO: 539352 - RNA, 32 nt, Human
uugagaccagccuggccaccauggugagaccc

SEQ ID NO: 539353 - RNA, 32 nt, Human
uugagaccagccuggccagcauggcgaaaccu

SEQ ID NO: 539354 - RNA, 32 nt, Human
uugagaccagccuggccagcauggugaaaccc

SEQ ID NO: 539355 - RNA, 32 nt, Human
uugagaccagccuggcccacauggugaaaccc

SEQ ID NO: 539356 - RNA, 32 nt, Human
uugagaccagccuggccgacauggugaaaccc

SEQ ID NO: 539357 - RNA, 32 nt, Human
uugagaccagccuggcuaacauggugaaaucc

SEQ ID NO: 539358 - RNA, 32 nt, Human
uugagaccagccuggcugacaggguaaaaccc

SEQ ID NO: 539359 - RNA, 21 nt, Human
uugagaccagccugggcaaca

SEQ ID NO: 539360 - RNA, 32 nt, Human
uugagaccagccugggcaacaaagugagaccc

SEQ ID NO: 539361 - RNA, 32 nt, Human
uugagaccagccugggcaacacggugaaaccc

SEQ ID NO: 539362 - RNA, 32 nt, Human
uugagaccagccugggcaacagagugagacuc

SEQ ID NO: 539363 - RNA, 32 nt, Human
uugagaccagccugggcaacaggguaaggucc

SEQ ID NO: 539364 - RNA, 32 nt, Human
uugagaccagccugggcaacauaguaagaccu

SEQ ID NO: 539365 - RNA, 32 nt, Human
uugagaccagccugggcaacauaguaagacgc

SEQ ID NO: 539366 - RNA, 32 nt, Human
uugagaccagccugggcaacauagugagacug

SEQ ID NO: 539367 - RNA, 32 nt, Human
uugagaccagccugggcaacauagugagaucc

SEQ ID NO: 539368 - RNA, 32 nt, Human
uugagaccagccugggcaacauagugaggccc

SEQ ID NO: 539369 - RNA, 32 nt, Human
uugagaccagccugggcaacauagugagugag

SEQ ID NO: 539370 - RNA, 32 nt, Human
uugagaccagccugggcaacauagugauaccc

SEQ ID NO: 539371 - RNA, 32 nt, Human
uugagaccagccugggcaacaucaugagacgu

SEQ ID NO: 539372 - RNA, 23 nt, Human
uugagaccagccugggcaacaug

SEQ ID NO: 539373 - RNA, 32 nt, Human
uugagaccagccugggcaacaugaugaaaacu

SEQ ID NO: 539374 - RNA, 32 nt, Human
uugagaccagccugggcaacauggagaaaccc

SEQ ID NO: 539375 - RNA, 32 nt, Human
uugagaccagccugggcaacauggagagaccc

SEQ ID NO: 539376 - RNA, 32 nt, Human
uugagaccagccugggcaacauggcaaaaacc

SEQ ID NO: 539377 - RNA, 32 nt, Human
uugagaccagccugggcaacauggcaaaaccc

SEQ ID NO: 539378 - RNA, 32 nt, Human
uugagaccagccugggcaacauggcaaaaucc

SEQ ID NO: 539379 - RNA, 32 nt, Human
uugagaccagccugggcaacauggcaagaccc

SEQ ID NO: 539380 - RNA, 32 nt, Human
uugagaccagccugggcaacauggcacaauug

SEQ ID NO: 539381 - RNA, 32 nt, Human
uugagaccagccugggcaacauggcgaggccu

SEQ ID NO: 539382 - RNA, 32 nt, Human
uugagaccagccugggcaacauggcuaaaccc

SEQ ID NO: 539383 - RNA, 32 nt, Human
uugagaccagccugggcaacauggugaaaccc

SEQ ID NO: 539384 - RNA, 32 nt, Human
uugagaccagccugggcaauauagugagaccu

SEQ ID NO: 539385 - RNA, 32 nt, Human
uugagaccagccugggcaauaucgugagaccc

SEQ ID NO: 539386 - RNA, 32 nt, Human
uugagaccagccugggcaauauggugagacuc

SEQ ID NO: 539387 - RNA, 32 nt, Human
uugagaccagccugggcaccauggugaaaccu

SEQ ID NO: 539388 - RNA, 32 nt, Human
uugagaccagccugggcgauauagugaggccc

SEQ ID NO: 539389 - RNA, 23 nt, Human
uugagaccagccuggggaacaua

SEQ ID NO: 539390 - RNA, 32 nt, Human
uugagaccagccuggggaacauagugagaccc

SEQ ID NO: 539391 - RNA, 32 nt, Human
uugagaccagccuggguaacauagugagaccc

SEQ ID NO: 539392 - RNA, 32 nt, Human
uugagaccagccuggguaacaugauaaaaccu

SEQ ID NO: 539393 - RNA, 32 nt, Human
uugagaccagccugguaaaauagugagaccuc

SEQ ID NO: 539394 - RNA, 32 nt, Human
uugagaccagccuggucaacauggcgaaaccc

SEQ ID NO: 539395 - RNA, 32 nt, Human
uugagaccagccuggucaacaugguaaaaccc

SEQ ID NO: 539396 - RNA, 32 nt, Human
uugagaccagccuugacaacauggugaaaccc

SEQ ID NO: 539397 - RNA, 32 nt, Human
uugagaccagccuugccaacacagugaaaccc

SEQ ID NO: 539398 - RNA, 32 nt, Human
uugagaccagcguggcuaacacggugaaaccc

SEQ ID NO: 539399 - RNA, 32 nt, Human
uugagaccagcuuagccaacauaguaagaccc

SEQ ID NO: 539400 - RNA, 32 nt, Human
uugagaccagcuuggccaacauggugaaaccc

SEQ ID NO: 539401 - RNA, 32 nt, Human
uugagaccagcuuggccaacauggugaaaucc

SEQ ID NO: 539402 - RNA, 23 nt, Human
uugagaccagcuugggcaacaug

SEQ ID NO: 539403 - RNA, 32 nt, Human
uugagaccagcuugggcaacauggugaaacuu

SEQ ID NO: 539404 - RNA, 32 nt, Human
uugagaccaggaaguugaggcugcaaugagcc

SEQ ID NO: 539405 - RNA, 32 nt, Human
uugagaccaggaauucaagaccagccugggca

SEQ ID NO: 539406 - RNA, 32 nt, Human
uugagaccaggagaucaaggcugcagcgagcu

SEQ ID NO: 539407 - RNA, 32 nt, Human
uugagaccaggagcucgaggcuguaaugugcc

SEQ ID NO: 539408 - RNA, 32 nt, Human
uugagaccaggaggucaagaccagccuggcca

SEQ ID NO: 539409 - RNA, 32 nt, Human
uugagaccaggaguucaagaccagccugagaa

SEQ ID NO: 539410 - RNA, 32 nt, Human
uugagaccaggaguucaagaccagccugggca

SEQ ID NO: 539411 - RNA, 32 nt, Human
uugagaccaggaguucgagaccagccugagaa

SEQ ID NO: 539412 - RNA, 32 nt, Human
uugagaccaggaguucgagaccagccuggcca

SEQ ID NO: 539413 - RNA, 32 nt, Human
uugagaccaggaguucgagaccagccugggca

SEQ ID NO: 539414 - RNA, 32 nt, Human
uugagaccaggaguuugagaccagccuaggca

SEQ ID NO: 539415 - RNA, 32 nt, Human
uugagaccaggaguuugaggcuucagugagcu

SEQ ID NO: 539416 - RNA, 32 nt, Human
uugagaccaggcugggcaacauggugaaaccc

SEQ ID NO: 539417 - RNA, 32 nt, Human
uugagaccagguguucaagaccagccucauca

SEQ ID NO: 539418 - RNA, 32 nt, Human
uugagaccagucuggccaacaaggcgaaaccc

SEQ ID NO: 539419 - RNA, 32 nt, Human
uugagaccagucuggccaacauggcgaaaccc

SEQ ID NO: 539420 - RNA, 32 nt, Human
uugagaccagucuggccaacauggugaaaccc

SEQ ID NO: 539421 - RNA, 32 nt, Human
uugagaccaguguggccaacauggugaaaccc

SEQ ID NO: 539422 - RNA, 32 nt, Human
uugagaccaucccggcuaacacggugaaaccc

SEQ ID NO: 539423 - RNA, 32 nt, Human
uugagaccauccugaguaacauggugaaaccc

SEQ ID NO: 539424 - RNA, 32 nt, Human
uugagaccauccuggauaacauggugaaacca

SEQ ID NO: 539425 - RNA, 32 nt, Human
uugagaccauccuggcaaacauggugaaaccc

SEQ ID NO: 539426 - RNA, 32 nt, Human
uugagaccauccuggccaacauggugaaaccc

SEQ ID NO: 539427 - RNA, 32 nt, Human
uugagaccauccuggccaacauggugaaaccu

SEQ ID NO: 539428 - RNA, 32 nt, Human
uugagaccauccuggccagcauggugaaaccc

SEQ ID NO: 539429 - RNA, 32 nt, Human
uugagaccauccuggcuaacacagugaaaccc

SEQ ID NO: 539430 - RNA, 32 nt, Human
uugagaccauccuggcuaacacagugaaaucc

SEQ ID NO: 539431 - RNA, 32 nt, Human
uugagaccauccuggcuaacacggugaaaccc

SEQ ID NO: 539432 - RNA, 32 nt, Human
uugagaccauccuggcuaacacggugaaacuc

SEQ ID NO: 539433 - RNA, 32 nt, Human
uugagaccauccuggcuaacacggugagaccc

SEQ ID NO: 539434 - RNA, 32 nt, Human
uugagaccauccuggcuaacauggugaaaccc

SEQ ID NO: 539435 - RNA, 32 nt, Human
uugagaccauccugggcaacauggcgaaaccc

SEQ ID NO: 539436 - RNA, 20 nt, Human
uugagacccaaguggcaggg

SEQ ID NO: 539437 - RNA, 32 nt, Human
uugagacccaggaggugugcggaugggucccu

SEQ ID NO: 539438 - RNA, 32 nt, Human
uugagacccaggccuggcugguccugccagga

SEQ ID NO: 539439 - RNA, 32 nt, Human
uugagaccggcaugaggauggaagaggcucag

SEQ ID NO: 539440 - RNA, 32 nt, Human
uugagaccggccuggccaacauggugaaaccc

SEQ ID NO: 539441 - RNA, 32 nt, Human
uugagaccggccuggccagcguggugaagccu

SEQ ID NO: 539442 - RNA, 32 nt, Human
uugagaccguccuggcuaacacggugaaaccu

SEQ ID NO: 539443 - RNA, 32 nt, Human
uugagaccugccuggccaacaugaugaaaccc

SEQ ID NO: 539444 - RNA, 32 nt, Human
uugagaccuuccuggcuaacauggugaaaccc

SEQ ID NO: 539445 - RNA, 32 nt, Human
uugagacgagggcagagaacaggaagauacau

SEQ ID NO: 539446 - RNA, 32 nt, Human
uugagacgcaggaggggcugggcaucgaguac

SEQ ID NO: 539447 - RNA, 32 nt, Human
uugagacggagauucacuuuuguugcccaggc

SEQ ID NO: 539448 - RNA, 32 nt, Human
uugagacggagauucgcucugucgccaggcug

SEQ ID NO: 539449 - RNA, 32 nt, Human
uugagacggaguccagccugggcaacagagua

SEQ ID NO: 539450 - RNA, 21 nt, Human
uugagacggagucucacucug

SEQ ID NO: 539451 - RNA, 32 nt, Human
uugagacggagucucgcucugccgcccaggcu

SEQ ID NO: 539452 - RNA, 32 nt, Human
uugagacggagucugcucugucgcucgcgcug

SEQ ID NO: 539453 - RNA, 32 nt, Human
uugagacggagucuugcucugccgcccaggcg

SEQ ID NO: 539454 - RNA, 32 nt, Human
uugagacggaguuucacgcuuauugcccaggc

SEQ ID NO: 539455 - RNA, 32 nt, Human
uugagacggaguuucacucuuauugcccaggc

SEQ ID NO: 539456 - RNA, 32 nt, Human
uugagacggaguuucacucuugucacccaggc

SEQ ID NO: 539457 - RNA, 32 nt, Human
uugagacggaguuucacucuuguugcccaggc

SEQ ID NO: 539458 - RNA, 32 nt, Human
uugagacggaguuucacuuuuguugcccaggc

SEQ ID NO: 539459 - RNA, 32 nt, Human
uugagacggaguuucccucuguugcccaggcu

SEQ ID NO: 539460 - RNA, 32 nt, Human
uugagacggaguuucccucuuguugcccgggc

SEQ ID NO: 539461 - RNA, 32 nt, Human
uugagacggaguuucgcucugucgcccaggcu

SEQ ID NO: 539462 - RNA, 32 nt, Human
uugagacggaguuucgcucuuauugcccaggc

SEQ ID NO: 539463 - RNA, 32 nt, Human
uugagacggaguuucgcucuuggugcccaggc

SEQ ID NO: 539464 - RNA, 23 nt, Human
uugagacggaguuucgcucuugu

SEQ ID NO: 539465 - RNA, 32 nt, Human
uugagacggaguuucgcucuugucaccccagc

SEQ ID NO: 539466 - RNA, 32 nt, Human
uugagacggaguuucgcucuugucgcccaggc

SEQ ID NO: 539467 - RNA, 32 nt, Human
uugagacggaguuucgcucuuguugcccaagc

SEQ ID NO: 539468 - RNA, 32 nt, Human
uugagacggaguuucgcuguuguugcccaggc

SEQ ID NO: 539469 - RNA, 32 nt, Human
uugagacggaguuucgcuuuugucccccaagc

SEQ ID NO: 539470 - RNA, 32 nt, Human
uugagacggaguuucucucuuguuacccaggc

SEQ ID NO: 539471 - RNA, 32 nt, Human
uugagacggaguuuugcucuuguagcccaggc

SEQ ID NO: 539472 - RNA, 32 nt, Human
uugagacggaguuuugcucuuguuacccaggc

SEQ ID NO: 539473 - RNA, 32 nt, Human
uugagacggaguuuugcucuuguugcccaggc

SEQ ID NO: 539474 - RNA, 32 nt, Human
uugagacggaguuuuguucuuguugcccaggc

SEQ ID NO: 539475 - RNA, 32 nt, Human
uugagacgggguuucgcucuuguuguccaggc

SEQ ID NO: 539476 - RNA, 32 nt, Human
uugagacgguccuggcuaacacggugaaaccc

SEQ ID NO: 539477 - RNA, 32 nt, Human
uugagacggucucauucugucacccagacugg

SEQ ID NO: 539478 - RNA, 22 nt, Human
uugagacuacaggcaugagcca

SEQ ID NO: 539479 - RNA, 32 nt, Human
uugagacuagccucacuaacauggugaaaccc

SEQ ID NO: 539480 - RNA, 32 nt, Human
uugagacuagccuggcaaacaugaugaaaccc

SEQ ID NO: 539481 - RNA, 32 nt, Human
uugagacuagccuggccaacauggugagaccc

SEQ ID NO: 539482 - RNA, 32 nt, Human
uugagacuagccuggccaagauggugaaaccc

SEQ ID NO: 539483 - RNA, 32 nt, Human
uugagacuagccuggccaauauagugggaccc

SEQ ID NO: 539484 - RNA, 32 nt, Human
uugagacuagccuggccaauauggugaaaccc

SEQ ID NO: 539485 - RNA, 32 nt, Human
uugagacuagccuggccagcauggugaaaccu

SEQ ID NO: 539486 - RNA, 32 nt, Human
uugagacuagccugggcaacauggugaaaccc

SEQ ID NO: 539487 - RNA, 32 nt, Human
uugagacuagccugggcaacauggugagaccc

SEQ ID NO: 539488 - RNA, 32 nt, Human
uugagacuagcuuggccaacauagugaaaccc

SEQ ID NO: 539489 - RNA, 32 nt, Human
uugagacuaggaguuugaggcugcagugaacu

SEQ ID NO: 539490 - RNA, 32 nt, Human
uugagacuagucuggccaacauggugaaacac

SEQ ID NO: 539491 - RNA, 32 nt, Human
uugagacuccacuguucucaaacaccucuaac

SEQ ID NO: 539492 - RNA, 32 nt, Human
uugagacugaaauuuaaaaauauugagaauaa

SEQ ID NO: 539493 - RNA, 32 nt, Human
uugagacugagaguuggaggcugcgaugagcc

SEQ ID NO: 539494 - RNA, 32 nt, Human
uugagacugaguagaugaauuauugaauguga

SEQ ID NO: 539495 - RNA, 32 nt, Human
uugagacugaguuucacucuuguugcccaggc

SEQ ID NO: 539496 - RNA, 32 nt, Human
uugagacugaguuucgcucuugucauccuggc

SEQ ID NO: 539497 - RNA, 32 nt, Human
uugagacugcuugcccgugggcucagaaguga

SEQ ID NO: 539498 - RNA, 32 nt, Human
uugagagaaaagcuccuuuucucuucacuguu

SEQ ID NO: 539499 - RNA, 32 nt, Human
uugagagaaagggagagagggagggagagaga

SEQ ID NO: 539500 - RNA, 32 nt, Human
uugagagaacgaggaggaaggagagaaaaugg

SEQ ID NO: 539501 - RNA, 32 nt, Human
uugagagaacuccaugcugguggagaaaaaca

SEQ ID NO: 539502 - RNA, 32 nt, Human
uugagagacugaggcaggagaaucgcuugaac

SEQ ID NO: 539503 - RNA, 32 nt, Human
uugagagagacacuacaugacuccaaguauau

SEQ ID NO: 539504 - RNA, 32 nt, Human
uugagagagcccagaggggcagagcccagagc

SEQ ID NO: 539505 - RNA, 32 nt, Human
uugagagagcuaugcuauagaggggaaaauga

SEQ ID NO: 539506 - RNA, 32 nt, Human
uugagagagcuggaaggcaugguggcuaaggg

SEQ ID NO: 539507 - RNA, 24 nt, Human
uugagagaggaacaacagaacagu

SEQ ID NO: 539508 - RNA, 32 nt, Human
uugagagcagccagggcaacacagcgagaccc

SEQ ID NO: 539509 - RNA, 32 nt, Human
uugagagcagccuggccaacagaggugagcac

SEQ ID NO: 539510 - RNA, 32 nt, Human
uugagagcagccuggcuaacauggugaaaccc

SEQ ID NO: 539511 - RNA, 32 nt, Human
uugagagcauaggccuugguggcaggugcauc

SEQ ID NO: 539512 - RNA, 32 nt, Human
uugagagccagccacagccucuggggagccag

SEQ ID NO: 539513 - RNA, 32 nt, Human
uugagagcccuagaaagcugcugugaucccag

SEQ ID NO: 539514 - RNA, 32 nt, Human
uugagagcuucacacagacaaugagagagggu

SEQ ID NO: 539515 - RNA, 17 nt, Human
uugagaggaacagaaag

SEQ ID NO: 539516 - RNA, 32 nt, Human
uugagaggcacccccuuccuccgucaucacag

SEQ ID NO: 539517 - RNA, 32 nt, Human
uugagaggcagaggcaggagaaucgcuugaac

SEQ ID NO: 539518 - RNA, 32 nt, Human
uugagaggcagaggcaggaggaucaggagccc

SEQ ID NO: 539519 - RNA, 32 nt, Human
uugagaggccaaggcagguggaucacgagguc

SEQ ID NO: 539520 - RNA, 32 nt, Human
uugagaggccgaggcaggcggaucaugagguc

SEQ ID NO: 539521 - RNA, 32 nt, Human
uugagaggccgaggcggguagaucacuuuagg

SEQ ID NO: 539522 - RNA, 32 nt, Human
uugagaggccgaggcgggugggucaccugagg

SEQ ID NO: 539523 - RNA, 32 nt, Human
uugagaggccgaggcggguguaucaccugagg

SEQ ID NO: 539524 - RNA, 32 nt, Human
uugagaggccgagguggguggaucacgaguuc

SEQ ID NO: 539525 - RNA, 32 nt, Human
uugagaggcgaggagguagugggugaggcuac

SEQ ID NO: 539526 - RNA, 32 nt, Human
uugagaggcuaacucucccaaaaaggaccaug

SEQ ID NO: 539527 - RNA, 32 nt, Human
uugagaggcugaagaggguggaucaugaggug

SEQ ID NO: 539528 - RNA, 32 nt, Human
uugagaggcugaagcagaagaaucucuugagc

SEQ ID NO: 539529 - RNA, 32 nt, Human
uugagaggcugaagcagaauuauuugaggcca

SEQ ID NO: 539530 - RNA, 32 nt, Human
uugagaggcugaaguagauguuucagcugaaa

SEQ ID NO: 539531 - RNA, 32 nt, Human
uugagaggcugagacacgagaaucacuugaac

SEQ ID NO: 539532 - RNA, 32 nt, Human
uugagaggcugagauaggagaaucacuggaac

SEQ ID NO: 539533 - RNA, 32 nt, Human
uugagaggcugagcgggguggaucauuugagg

SEQ ID NO: 539534 - RNA, 32 nt, Human
uugagaggcugaggaggguggaucauuugagg

SEQ ID NO: 539535 - RNA, 32 nt, Human
uugagaggcugaggcaggagaaucgcuugaac

SEQ ID NO: 539536 - RNA, 32 nt, Human
uugagaggcugaggcggguggaucaccugagg

SEQ ID NO: 539537 - RNA, 32 nt, Human
uugagaggcugaggcggguggaucacuugagg

SEQ ID NO: 539538 - RNA, 32 nt, Human
uugagaggcugaggugggaggaucauuugagu

SEQ ID NO: 539539 - RNA, 32 nt, Human
uugagaggcugagguggguggaucacuugagg

SEQ ID NO: 539540 - RNA, 32 nt, Human
uugagaggcuggggcaggagaaucacuagaac

SEQ ID NO: 539541 - RNA, 32 nt, Human
uugagagggaguuucacucuuguugcccaggc

SEQ ID NO: 539542 - RNA, 32 nt, Human
uugagaggggagguggaguuggaaaugugggu

SEQ ID NO: 539543 - RNA, 32 nt, Human
uugagaggggcuggauguaaucaccuuugguu

SEQ ID NO: 539544 - RNA, 32 nt, Human
uugagaggggcuuugcugaggcuuccccuugg

SEQ ID NO: 539545 - RNA, 32 nt, Human
uugagaggucaaagugggagaaucacuugagc

SEQ ID NO: 539546 - RNA, 32 nt, Human
uugagaguagagcuagggccccagggauugcu

SEQ ID NO: 539547 - RNA, 32 nt, Human
uugagagucccugaagccaggauauuagaaga

SEQ ID NO: 539548 - RNA, 32 nt, Human
uugagaguccucccuccccaaccuccuccauu

SEQ ID NO: 539549 - RNA, 32 nt, Human
uugagagucugaagcaggagaauugcuugaac

SEQ ID NO: 539550 - RNA, 32 nt, Human
uugagagugacugccuggcccugcugcaacac

SEQ ID NO: 539551 - RNA, 32 nt, Human
uugagaguggcaucuauuagauucagaccacc

SEQ ID NO: 539552 - RNA, 32 nt, Human
uugagaguugggggcugggaagggcggggccc

SEQ ID NO: 539553 - RNA, 32 nt, Human
uugagauaccacaaacccugcugaacacagug

SEQ ID NO: 539554 - RNA, 32 nt, Human
uugagauaccacaaacccugcugaacagagug

SEQ ID NO: 539555 - RNA, 32 nt, Human
uugagauaguuuuuccagagcuggaggucacg

SEQ ID NO: 539556 - RNA, 32 nt, Human
uugagauauaucuccaaaaaccaucuucauuu

SEQ ID NO: 539557 - RNA, 32 nt, Human
uugagaucaagaguucaagaccagccuggcca

SEQ ID NO: 539558 - RNA, 22 nt, Human
uugagaucacaggcgugagcca

SEQ ID NO: 539559 - RNA, 32 nt, Human
uugagaucagcccgggcaacauggugaaaccc

SEQ ID NO: 539560 - RNA, 32 nt, Human
uugagaucagcccugggcaacauagugagacc

SEQ ID NO: 539561 - RNA, 32 nt, Human
uugagaucagccugcccaacauggugaaaccu

SEQ ID NO: 539562 - RNA, 32 nt, Human
uugagaucagccuggagaacaaagugagaccc

SEQ ID NO: 539563 - RNA, 32 nt, Human
uugagaucagccuggcaaacauggcgacaccc

SEQ ID NO: 539564 - RNA, 32 nt, Human
uugagaucagccuggccaacagacgugagcca

SEQ ID NO: 539565 - RNA, 32 nt, Human
uugagaucagccuggccaacauagugaaaccc

SEQ ID NO: 539566 - RNA, 32 nt, Human
uugagaucagccuggccaacauggugaaaccc

SEQ ID NO: 539567 - RNA, 32 nt, Human
uugagaucagccuggccaauauggugaaaccc

SEQ ID NO: 539568 - RNA, 32 nt, Human
uugagaucagccuggccaaugugguaaaaccu

SEQ ID NO: 539569 - RNA, 32 nt, Human
uugagaucagccuggccaauguggugaaaccc

SEQ ID NO: 539570 - RNA, 32 nt, Human
uugagaucagccuggccagcauggcgaaaccc

SEQ ID NO: 539571 - RNA, 32 nt, Human
uugagaucagccugggcaacauggugaaaccu

SEQ ID NO: 539572 - RNA, 32 nt, Human
uugagaucagccugggcaacaugguggaaccc

SEQ ID NO: 539573 - RNA, 32 nt, Human
uugagaucagccugggcaaugugauaaaaccc

SEQ ID NO: 539574 - RNA, 32 nt, Human
uugagaucaggaguucaagaccagccuggcca

SEQ ID NO: 539575 - RNA, 32 nt, Human
uugagaucaggaguucgagaccagccuggcca

SEQ ID NO: 539576 - RNA, 32 nt, Human
uugagaucaggaguucgagaccagccuggugc

SEQ ID NO: 539577 - RNA, 32 nt, Human
uugagaucaggaguuugaaaccagccuggcca

SEQ ID NO: 539578 - RNA, 32 nt, Human
uugagaucaggaguuugagaccagccuggcca

SEQ ID NO: 539579 - RNA, 32 nt, Human
uugagaucaggggaagauggcagauaggaggc

SEQ ID NO: 539580 - RNA, 32 nt, Human
uugagaucaucccggccaacauagugaaaccc

SEQ ID NO: 539581 - RNA, 32 nt, Human
uugagaucauccuggccaacacggugaaaccc

SEQ ID NO: 539582 - RNA, 32 nt, Human
uugagaucgcacuccagccugggugacagagu

SEQ ID NO: 539583 - RNA, 32 nt, Human
uugagaucgccacugcacuccagccugggaaa

SEQ ID NO: 539584 - RNA, 32 nt, Human
uugagaucuaguuugccagcuccugggaaaca

SEQ ID NO: 539585 - RNA, 19 nt, Human
uugagaucucacagccaca

SEQ ID NO: 539586 - RNA, 32 nt, Human
uugagaucugcugacagauguuccauccugua

SEQ ID NO: 539587 - RNA, 32 nt, Human
uugagaucuuuguucccugaggugccaggcag

SEQ ID NO: 539588 - RNA, 32 nt, Human
uugagaugaagucucccucuuguuacccaggc

SEQ ID NO: 539589 - RNA, 32 nt, Human
uugagaugaaguuuuacucuuguugcccaggc

SEQ ID NO: 539590 - RNA, 32 nt, Human
uugagaugaaguuuugcucuuguuccccaggc

SEQ ID NO: 539591 - RNA, 32 nt, Human
uugagaugaugugguuuucaucuuucauuaug

SEQ ID NO: 539592 - RNA, 32 nt, Human
uugagaugaugugguuuucaucuuucauucug

SEQ ID NO: 539593 - RNA, 30 nt, Human
uugagaugauugagaagaugcagggaagca

SEQ ID NO: 539594 - RNA, 32 nt, Human
uugagaugcagagucuagagugcaguggugca

SEQ ID NO: 539595 - RNA, 32 nt, Human
uugagaugcaggagaaaggaagaggcauaaga

SEQ ID NO: 539596 - RNA, 31 nt, Human
uugagaugccucucuguggauccugucaccu

SEQ ID NO: 539597 - RNA, 32 nt, Human
uugagaugcucccaggguggacccacacauug

SEQ ID NO: 539598 - RNA, 32 nt, Human
uugagaugcugaggcagguggaucauuugagg

SEQ ID NO: 539599 - RNA, 32 nt, Human
uugagauggaauuuugcucuugucacccaggc

SEQ ID NO: 539600 - RNA, 32 nt, Human
uugagauggagucucgcucucuugcccaggcu

SEQ ID NO: 539601 - RNA, 32 nt, Human
uugagauggagucucgcucuugucgcccaggc

SEQ ID NO: 539602 - RNA, 32 nt, Human
uugagauggagucuugcucuugucgcccaggc

SEQ ID NO: 539603 - RNA, 32 nt, Human
uugagauggaguuucacccuuguugcccaggc

SEQ ID NO: 539604 - RNA, 32 nt, Human
uugagauggaguuucaccuuauucccaggcug

SEQ ID NO: 539605 - RNA, 32 nt, Human
uugagauggaguuucacucugucucccaggcu

SEQ ID NO: 539606 - RNA, 32 nt, Human
uugagauggaguuucacucuugcugcccaggc

SEQ ID NO: 539607 - RNA, 32 nt, Human
uugagauggaguuucacucuugucaaccagau

SEQ ID NO: 539608 - RNA, 32 nt, Human
uugagauggaguuucacucuugucacccaggc

SEQ ID NO: 539609 - RNA, 32 nt, Human
uugagauggaguuucacucuugucaccgaggc

SEQ ID NO: 539610 - RNA, 32 nt, Human
uugagauggaguuucacucuugucaccuagac

SEQ ID NO: 539611 - RNA, 32 nt, Human
uugagauggaguuucacucuugucucccagac

SEQ ID NO: 539612 - RNA, 32 nt, Human
uugagauggaguuucacucuugugcccaggcu

SEQ ID NO: 539613 - RNA, 32 nt, Human
uugagauggaguuucacucuuguugcccacgc

SEQ ID NO: 539614 - RNA, 32 nt, Human
uugagauggaguuucacucuuguugcccaggc

SEQ ID NO: 539615 - RNA, 32 nt, Human
uugagauggaguuucacucuuuuuacccaggc

SEQ ID NO: 539616 - RNA, 32 nt, Human
uugagauggaguuucacuguuguuccccaggc

SEQ ID NO: 539617 - RNA, 32 nt, Human
uugagauggaguuucagucuuguugcccaggc

SEQ ID NO: 539618 - RNA, 32 nt, Human
uugagauggaguuucauucuuguugccgaggc

SEQ ID NO: 539619 - RNA, 32 nt, Human
uugagauggaguuucauucuuguugccuaggc

SEQ ID NO: 539620 - RNA, 32 nt, Human
uugagauggaguuucgcgcuuguugcccaggc

SEQ ID NO: 539621 - RNA, 32 nt, Human
uugagauggaguuucgcucuguugccaggcug

SEQ ID NO: 539622 - RNA, 32 nt, Human
uugagauggaguuucgcucuguugcccaggcu

SEQ ID NO: 539623 - RNA, 32 nt, Human
uugagauggaguuucgcucuguuguccaggcu

SEQ ID NO: 539624 - RNA, 32 nt, Human
uugagauggaguuucgcucuugucacccacgc

SEQ ID NO: 539625 - RNA, 32 nt, Human
uugagauggaguuucgcucuuguugcccaggc

SEQ ID NO: 539626 - RNA, 32 nt, Human
uugagauggaguuucgcuguugucacccaggc

SEQ ID NO: 539627 - RNA, 32 nt, Human
uugagauggaguuucgcuuuuguugcccaggc

SEQ ID NO: 539628 - RNA, 32 nt, Human
uugagauggaguuucgugcuuguugcccaggc

SEQ ID NO: 539629 - RNA, 32 nt, Human
uugagauggaguuucguucuuguugcccaacc

SEQ ID NO: 539630 - RNA, 32 nt, Human
uugagauggaguuucucucuuguugcccaggc

SEQ ID NO: 539631 - RNA, 32 nt, Human
uugagauggaguuucucuugucaaccgggcug

SEQ ID NO: 539632 - RNA, 32 nt, Human
uugagauggaguuuggcuguugucucccaggc

SEQ ID NO: 539633 - RNA, 32 nt, Human
uugagauggaguuugguucuguccccgaggcc

SEQ ID NO: 539634 - RNA, 32 nt, Human
uugagauggaguuuucacucuuaucgcccagg

SEQ ID NO: 539635 - RNA, 30 nt, Human
uugagauggaguuuucgcucuuguugccca

SEQ ID NO: 539636 - RNA, 32 nt, Human
uugagauggaguuuugcucucguugccaaggc

SEQ ID NO: 539637 - RNA, 32 nt, Human
uugagauggaguuuugcucugucacccaggcu

SEQ ID NO: 539638 - RNA, 32 nt, Human
uugagauggaguuuugcucuuauugcccaggc

SEQ ID NO: 539639 - RNA, 32 nt, Human
uugagauggaguuuugcucuugcacuccaucc

SEQ ID NO: 539640 - RNA, 32 nt, Human
uugagauggaguuuugcucuuguagcccaggc

SEQ ID NO: 539641 - RNA, 32 nt, Human
uugagauggaguuuugcucuugucggccaggc

SEQ ID NO: 539642 - RNA, 32 nt, Human
uugagauggaguuuugcucuuguugcccagac

SEQ ID NO: 539643 - RNA, 32 nt, Human
uugagauggaguuuugcucuuguugcccaggc

SEQ ID NO: 539644 - RNA, 32 nt, Human
uugagauggaguuuugcucuuguugcugaggc

SEQ ID NO: 539645 - RNA, 32 nt, Human
uugagauggggcccaaaggacucccccugaag

SEQ ID NO: 539646 - RNA, 32 nt, Human
uugagauggggcuucucuuauugcccaggcug

SEQ ID NO: 539647 - RNA, 32 nt, Human
uugagauggggucuuggagugcaagugguaug

SEQ ID NO: 539648 - RNA, 32 nt, Human
uugagaugucuggaaguccaggaugacaccga

SEQ ID NO: 539649 - RNA, 32 nt, Human
uugagaugugccaggcucuguucuaagcacuu

SEQ ID NO: 539650 - RNA, 22 nt, Human
uugagauuacaggcaugagcca

SEQ ID NO: 539651 - RNA, 22 nt, Human
uugagauuacaggcgugagcca

SEQ ID NO: 539652 - RNA, 32 nt, Human
uugagauuagccuggccaagauggugaaaccc

SEQ ID NO: 539653 - RNA, 32 nt, Human
uugagauuaugagacugacgugcugcccacug

SEQ ID NO: 539654 - RNA, 32 nt, Human
uugagauucaaaggaaucucacuguuccuaaa

SEQ ID NO: 539655 - RNA, 32 nt, Human
uugagauuccaucagccaggaagaagggguaa

SEQ ID NO: 539656 - RNA, 32 nt, Human
uugagauucuuuauacucucugccuucagcaa

SEQ ID NO: 539657 - RNA, 22 nt, Human
uugagauugcaggcaugagcca

SEQ ID NO: 539658 - RNA, 32 nt, Human
uugagauugcucuuaagcugauuucccaaaca

SEQ ID NO: 539659 - RNA, 32 nt, Human
uugagauuucacugcauuuccccacucugccc

SEQ ID NO: 539660 - RNA, 32 nt, Human
uugagauuuccagaggacccagaccuuuguuc

SEQ ID NO: 539661 - RNA, 32 nt, Human
uugagauuucccucguggugccaggguccggc

SEQ ID NO: 539662 - RNA, 32 nt, Human
uugagauuuccuccucccucuggcugggauau

SEQ ID NO: 539663 - RNA, 32 nt, Human
uugagauuuuacccucuccuccaaccauuuug

SEQ ID NO: 539664 - RNA, 32 nt, Human
uugagcaaagcaguucuuucagaucugcaagu

SEQ ID NO: 539665 - RNA, 32 nt, Human
uugagcaacuguacuccagcuuggcgacagag

SEQ ID NO: 539666 - RNA, 32 nt, Human
uugagcaacuugauaucaaagcaggaaacuca

SEQ ID NO: 539667 - RNA, 32 nt, Human
uugagcaagaagacaggagcuggggacauucu

SEQ ID NO: 539668 - RNA, 32 nt, Human
uugagcaauagaagggaagugggauccgagcc

SEQ ID NO: 539669 - RNA, 32 nt, Human
uugagcacagaacccucagcucuggugcgggc

SEQ ID NO: 539670 - RNA, 32 nt, Human
uugagcacaggaguucaagaccagcgugggca

SEQ ID NO: 539671 - RNA, 32 nt, Human
uugagcacaggaguucgagaccagccuggaca

SEQ ID NO: 539672 - RNA, 32 nt, Human
uugagcacaggaguuugagaccagccugugca

SEQ ID NO: 539673 - RNA, 32 nt, Human
uugagcacaggaguuugaggcugcagugaccu

SEQ ID NO: 539674 - RNA, 32 nt, Human
uugagcacaggcguucgagaccagccugggca

SEQ ID NO: 539675 - RNA, 32 nt, Human
uugagcaccccaaaucugaaaggcuucugaac

SEQ ID NO: 539676 - RNA, 32 nt, Human
uugagcaccucaucuuuugcucaaauugaaau

SEQ ID NO: 539677 - RNA, 32 nt, Human
uugagcaccuccucuaggcgcuggggagucca

SEQ ID NO: 539678 - RNA, 32 nt, Human
uugagcacgagacacuuuucaucuggagcagg

SEQ ID NO: 539679 - RNA, 32 nt, Human
uugagcacugccugggaccugugcugagagag

SEQ ID NO: 539680 - RNA, 22 nt, Human
uugagcacuuaggugacaggaa

SEQ ID NO: 539681 - RNA, 32 nt, Human
uugagcagaauuccuggaccuggguggggcuu

SEQ ID NO: 539682 - RNA, 32 nt, Human
uugagcagagaacugcagccaggaugcgcuca

SEQ ID NO: 539683 - RNA, 32 nt, Human
uugagcagauacaaugaucugcuuuagugaga

SEQ ID NO: 539684 - RNA, 32 nt, Human
uugagcagauccagggaucagugagaggagug

SEQ ID NO: 539685 - RNA, 32 nt, Human
uugagcagaugauugaagcccagauuugaaug

SEQ ID NO: 539686 - RNA, 32 nt, Human
uugagcaggacgugagcgcagagcagagccug

SEQ ID NO: 539687 - RNA, 32 nt, Human
uugagcagggggagcaucuuauauucacccuu

SEQ ID NO: 539688 - RNA, 32 nt, Human
uugagcagguucccugaagcaagagaacucug

SEQ ID NO: 539689 - RNA, 31 nt, Human
uugagcagugagagagggaagggacuaacgu

SEQ ID NO: 539690 - RNA, 32 nt, Human
uugagcagugguuuguaauucuccuugaagag

SEQ ID NO: 539691 - RNA, 32 nt, Human
uugagcauaggaguuugagaccagccugggua

SEQ ID NO: 539692 - RNA, 32 nt, Human
uugagcauaugagagucacauccaggugaugu

SEQ ID NO: 539693 - RNA, 32 nt, Human
uugagcauccacugcucaaaguccaggcuauu

SEQ ID NO: 539694 - RNA, 32 nt, Human
uugagcauccuuucauaugcuuucuggccauu

SEQ ID NO: 539695 - RNA, 32 nt, Human
uugagcaucuccucuucuugaaggccaaccug

SEQ ID NO: 539696 - RNA, 32 nt, Human
uugagcauuaucaaaauccugugguauuuaua

SEQ ID NO: 539697 - RNA, 32 nt, Human
uugagccaaggaguucaagaccaacuugggca

SEQ ID NO: 539698 - RNA, 32 nt, Human
uugagccaaggaguucaagaccagccugggca

SEQ ID NO: 539699 - RNA, 32 nt, Human
uugagccaaugaguuggaggcugcagugagcu

SEQ ID NO: 539700 - RNA, 32 nt, Human
uugagccacaguuuuuagaucagcaccuggaa

SEQ ID NO: 539701 - RNA, 32 nt, Human
uugagccacgacagugcaugcacuccagccug

SEQ ID NO: 539702 - RNA, 32 nt, Human
uugagccacugcacuccaaucugggugacaga

SEQ ID NO: 539703 - RNA, 32 nt, Human
uugagccacugcacuccagccucggccacagu

SEQ ID NO: 539704 - RNA, 32 nt, Human
uugagccacugcacuccagccugggugacagc

SEQ ID NO: 539705 - RNA, 32 nt, Human
uugagccacugcacuccagccugggugacuga

SEQ ID NO: 539706 - RNA, 32 nt, Human
uugagccagccccagcgccuggugcugcaguc

SEQ ID NO: 539707 - RNA, 32 nt, Human
uugagccaggagacagaagcugugagccucug

SEQ ID NO: 539708 - RNA, 32 nt, Human
uugagccaggaggaggagguugcagugagccg

SEQ ID NO: 539709 - RNA, 32 nt, Human
uugagccaggagguugagguugcagugagcug

SEQ ID NO: 539710 - RNA, 32 nt, Human
uugagccagggaggucaaggcugcagugagcc

SEQ ID NO: 539711 - RNA, 32 nt, Human
uugagccauugcucuccagccugggugacaca

SEQ ID NO: 539712 - RNA, 32 nt, Human
uugagcccaagagguagagguugcagugagcc

SEQ ID NO: 539713 - RNA, 32 nt, Human
uugagcccaagagguugaggcugcagugagcc

SEQ ID NO: 539714 - RNA, 32 nt, Human
uugagcccaagagucggagaccagccugggca

SEQ ID NO: 539715 - RNA, 32 nt, Human
uugagcccaagaguucaagaccagccugggaa

SEQ ID NO: 539716 - RNA, 32 nt, Human
uugagcccaagaguuccagaccagccuggcca

SEQ ID NO: 539717 - RNA, 32 nt, Human
uugagcccaagaguucgacgcugcagugagcu

SEQ ID NO: 539718 - RNA, 32 nt, Human
uugagcccaagaguucgagaccagccugggca

SEQ ID NO: 539719 - RNA, 32 nt, Human
uugagcccaagaguuggagaccagccugggca

SEQ ID NO: 539720 - RNA, 32 nt, Human
uugagcccaagaguuugagaccagccuaggug

SEQ ID NO: 539721 - RNA, 32 nt, Human
uugagcccaagaguuuuagaccagccugggca

SEQ ID NO: 539722 - RNA, 32 nt, Human
uugagcccacgagauggaaguugcagugaacu

SEQ ID NO: 539723 - RNA, 32 nt, Human
uugagcccacgaguucaaggcugcagugaguc

SEQ ID NO: 539724 - RNA, 32 nt, Human
uugagcccagaacagccuacaggggaaaaaca

SEQ ID NO: 539725 - RNA, 32 nt, Human
uugagcccagaagcucaaggcugcagugagcc

SEQ ID NO: 539726 - RNA, 32 nt, Human
uugagcccagaagcuugaagcugcagugagcu

SEQ ID NO: 539727 - RNA, 32 nt, Human
uugagcccagaaggucgaggcugcagggagcu

SEQ ID NO: 539728 - RNA, 32 nt, Human
uugagcccagaagguugaagcugcagugaguu

SEQ ID NO: 539729 - RNA, 32 nt, Human
uugagcccagaaguucaaggcugcaaugagcc

SEQ ID NO: 539730 - RNA, 32 nt, Human
uugagcccagaaguucgagguugcagugagcc

SEQ ID NO: 539731 - RNA, 32 nt, Human
uugagcccagaaguugaagaccagccugagaa

SEQ ID NO: 539732 - RNA, 32 nt, Human
uugagcccagaaguuugagaccagccuaggca

SEQ ID NO: 539733 - RNA, 32 nt, Human
uugagcccagaaguuugagaccagccugugca

SEQ ID NO: 539734 - RNA, 32 nt, Human
uugagcccagaaguuugaggcugcaaugagcc

SEQ ID NO: 539735 - RNA, 32 nt, Human
uugagcccagaggcggagguugcagugagccg

SEQ ID NO: 539736 - RNA, 32 nt, Human
uugagcccagagguagaggcugcagugagcca

SEQ ID NO: 539737 - RNA, 32 nt, Human
uugagcccagagguuugcaaccagccugagca

SEQ ID NO: 539738 - RNA, 32 nt, Human
uugagcccagcaguucaagaccagccugggca

SEQ ID NO: 539739 - RNA, 32 nt, Human
uugagcccagcaguucgagaccagccuggaca

SEQ ID NO: 539740 - RNA, 32 nt, Human
uugagcccagcaguuggaggcugcagugagcu

SEQ ID NO: 539741 - RNA, 32 nt, Human
uugagcccagcuugagcaacauagugaaaucc

SEQ ID NO: 539742 - RNA, 32 nt, Human
uugagcccaggaaacauagugagaccccuuac

SEQ ID NO: 539743 - RNA, 32 nt, Human
uugagcccaggaagucaaggcugcagugagcu

SEQ ID NO: 539744 - RNA, 32 nt, Human
uugagcccaggaaguggaggcugcagugaccu

SEQ ID NO: 539745 - RNA, 32 nt, Human
uugagcccaggaaguggagguugcagugagca

SEQ ID NO: 539746 - RNA, 32 nt, Human
uugagcccaggaaguugaggcugcagugagcu

SEQ ID NO: 539747 - RNA, 32 nt, Human
uugagcccaggaaucugagaccagccugagca

SEQ ID NO: 539748 - RNA, 32 nt, Human
uugagcccaggaauucaagaccagccugggca

SEQ ID NO: 539749 - RNA, 32 nt, Human
uugagcccaggaauucaagaccaguccgagca

SEQ ID NO: 539750 - RNA, 32 nt, Human
uugagcccaggaauucgagaccagccuaggug

SEQ ID NO: 539751 - RNA, 32 nt, Human
uugagcccaggaauucgagaccagccugggca

SEQ ID NO: 539752 - RNA, 32 nt, Human
uugagcccaggaauucgagaccagccugggcc

SEQ ID NO: 539753 - RNA, 32 nt, Human
uugagcccaggaauuggaggcugcagugagcu

SEQ ID NO: 539754 - RNA, 32 nt, Human
uugagcccaggaauuugagaccagccuggaca

SEQ ID NO: 539755 - RNA, 32 nt, Human
uugagcccaggaauuugagaccagccugggca

SEQ ID NO: 539756 - RNA, 32 nt, Human
uugagcccaggaauuugaggcugcagcgagca

SEQ ID NO: 539757 - RNA, 32 nt, Human
uugagcccaggaauuugaggcugcagugagcu

SEQ ID NO: 539758 - RNA, 32 nt, Human
uugagcccaggacaucgaggcugcggugaacc

SEQ ID NO: 539759 - RNA, 32 nt, Human
uugagcccaggacucuaaggcugcagugagcu

SEQ ID NO: 539760 - RNA, 32 nt, Human
uugagcccaggacuucaagaccagccuaggca

SEQ ID NO: 539761 - RNA, 32 nt, Human
uugagcccaggagaugcaggcuugcagugagc

SEQ ID NO: 539762 - RNA, 32 nt, Human
uugagcccaggagauuaagacuguaguauacu

SEQ ID NO: 539763 - RNA, 32 nt, Human
uugagcccaggagauugaggcugcagugagca

SEQ ID NO: 539764 - RNA, 32 nt, Human
uugagcccaggagauugaggcugcagugagcc

SEQ ID NO: 539765 - RNA, 32 nt, Human
uugagcccaggagcucaagaccagccuggaca

SEQ ID NO: 539766 - RNA, 32 nt, Human
uugagcccaggagcucgagaccagcuugguca

SEQ ID NO: 539767 - RNA, 32 nt, Human
uugagcccaggagcuggaggcugcagugaacu

SEQ ID NO: 539768 - RNA, 32 nt, Human
uugagcccaggaggaggaggcugcagugagcu

SEQ ID NO: 539769 - RNA, 32 nt, Human
uugagcccaggaggcagaauuugcagugagcu

SEQ ID NO: 539770 - RNA, 32 nt, Human
uugagcccaggaggcagaggcugcagugagcc

SEQ ID NO: 539771 - RNA, 32 nt, Human
uugagcccaggaggcagagguugcaguaagcc

SEQ ID NO: 539772 - RNA, 32 nt, Human
uugagcccaggaggcagagguugcagugagcc

SEQ ID NO: 539773 - RNA, 32 nt, Human
uugagcccaggaggccaagguugcagugggcc

SEQ ID NO: 539774 - RNA, 32 nt, Human
uugagcccaggaggcggagauugcagugagcc

SEQ ID NO: 539775 - RNA, 32 nt, Human
uugagcccaggaggcggaggcugcagugagcu

SEQ ID NO: 539776 - RNA, 32 nt, Human
uugagcccaggaggcggagguugcagugagcu

SEQ ID NO: 539777 - RNA, 32 nt, Human
uugagcccaggaggcugaggcugcaaugacug

SEQ ID NO: 539778 - RNA, 32 nt, Human
uugagcccaggaggcugaggcugcagugcauc

SEQ ID NO: 539779 - RNA, 32 nt, Human
uugagcccaggaggucaaggcuauggugagcc

SEQ ID NO: 539780 - RNA, 32 nt, Human
uugagcccaggaggucaaggcugcagugagcc

SEQ ID NO: 539781 - RNA, 32 nt, Human
uugagcccaggaggucaaggcugcagugagcu

SEQ ID NO: 539782 - RNA, 32 nt, Human
uugagcccaggaggucagggcugcagugagcc

SEQ ID NO: 539783 - RNA, 32 nt, Human
uugagcccaggaggucgaagcugcagugaggu

SEQ ID NO: 539784 - RNA, 32 nt, Human
uugagcccaggaggucgaggcugcagugagcc

SEQ ID NO: 539785 - RNA, 32 nt, Human
uugagcccaggaggucgaggcugcagugagcu

SEQ ID NO: 539786 - RNA, 32 nt, Human
uugagcccaggaggucgaggcugcagugggcc

SEQ ID NO: 539787 - RNA, 32 nt, Human
uugagcccaggaggucgaggcugcagugugcu

SEQ ID NO: 539788 - RNA, 32 nt, Human
uugagcccaggaggucgagguugcagugagca

SEQ ID NO: 539789 - RNA, 32 nt, Human
uugagcccaggaggucuaggcugcagugagcu

SEQ ID NO: 539790 - RNA, 32 nt, Human
uugagcccaggagguggaggcugcaaugagcu

SEQ ID NO: 539791 - RNA, 32 nt, Human
uugagcccaggagguggagguugcaaugagcc

SEQ ID NO: 539792 - RNA, 32 nt, Human
uugagcccaggagguggagguugcagugagca

SEQ ID NO: 539793 - RNA, 32 nt, Human
uugagcccaggagguggagguugcagugagcc

SEQ ID NO: 539794 - RNA, 32 nt, Human
uugagcccaggagguggagguugcagugagcg

SEQ ID NO: 539795 - RNA, 32 nt, Human
uugagcccaggagguggagguugcagugagcu

SEQ ID NO: 539796 - RNA, 32 nt, Human
uugagcccaggagguugaggcugcagugaacu

SEQ ID NO: 539797 - RNA, 32 nt, Human
uugagcccaggagguugaggcugcagugagca

SEQ ID NO: 539798 - RNA, 32 nt, Human
uugagcccaggagguugaggcugcagugagcc

SEQ ID NO: 539799 - RNA, 32 nt, Human
uugagcccaggagguugaggcugcagugagcu

SEQ ID NO: 539800 - RNA, 32 nt, Human
uugagcccaggagguugaggcugcagugaggu

SEQ ID NO: 539801 - RNA, 32 nt, Human
uugagcccaggagguugaggcugcagugaguu

SEQ ID NO: 539802 - RNA, 32 nt, Human
uugagcccaggagguugaggucacagugagcu

SEQ ID NO: 539803 - RNA, 32 nt, Human
uugagcccaggagguuguggcugcagugagcu

SEQ ID NO: 539804 - RNA, 32 nt, Human
uugagcccaggagucuaggaccagccuggaca

SEQ ID NO: 539805 - RNA, 32 nt, Human
uugagcccaggagucugagaccagccucggca

SEQ ID NO: 539806 - RNA, 32 nt, Human
uugagcccaggagucugagaccagccuggcca

SEQ ID NO: 539807 - RNA, 32 nt, Human
uugagcccaggagucugagaccagccugggca

SEQ ID NO: 539808 - RNA, 32 nt, Human
uugagcccaggagucugaggcuucagugaguu

SEQ ID NO: 539809 - RNA, 32 nt, Human
uugagcccaggagucugaggcuuuagugaucu

SEQ ID NO: 539810 - RNA, 32 nt, Human
uugagcccaggagugcaaggcugcaaugagcc

SEQ ID NO: 539811 - RNA, 32 nt, Human
uugagcccaggaguuaagaggcugcagugacc

SEQ ID NO: 539812 - RNA, 32 nt, Human
uugagcccaggaguuagagaccagcccagccu

SEQ ID NO: 539813 - RNA, 32 nt, Human
uugagcccaggaguuagagaccagccugggca

SEQ ID NO: 539814 - RNA, 32 nt, Human
uugagcccaggaguucaaaaccagccugggca

SEQ ID NO: 539815 - RNA, 32 nt, Human
uugagcccaggaguucaaagcugcagugaguc

SEQ ID NO: 539816 - RNA, 32 nt, Human
uugagcccaggaguucaaagcuguagugagcu

SEQ ID NO: 539817 - RNA, 32 nt, Human
uugagcccaggaguucaacaccagccugagca

SEQ ID NO: 539818 - RNA, 32 nt, Human
uugagcccaggaguucaagaccaaccugguga

SEQ ID NO: 539819 - RNA, 32 nt, Human
uugagcccaggaguucaagaccacccugggca

SEQ ID NO: 539820 - RNA, 32 nt, Human
uugagcccaggaguucaagaccagccugagca

SEQ ID NO: 539821 - RNA, 32 nt, Human
uugagcccaggaguucaagaccagccuggaca

SEQ ID NO: 539822 - RNA, 32 nt, Human
uugagcccaggaguucaagaccagccugggaa

SEQ ID NO: 539823 - RNA, 32 nt, Human
uugagcccaggaguucaagaccagccugggca

SEQ ID NO: 539824 - RNA, 32 nt, Human
uugagcccaggaguucaagaccagccugggcu

SEQ ID NO: 539825 - RNA, 32 nt, Human
uugagcccaggaguucaagaccagcuugggca

SEQ ID NO: 539826 - RNA, 32 nt, Human
uugagcccaggaguucaagaccagucugggca

SEQ ID NO: 539827 - RNA, 32 nt, Human
uugagcccaggaguucaagaccggccugagca

SEQ ID NO: 539828 - RNA, 32 nt, Human
uugagcccaggaguucaaggaugcagugugcu

SEQ ID NO: 539829 - RNA, 32 nt, Human
uugagcccaggaguucaaggcagcaaugagcu

SEQ ID NO: 539830 - RNA, 32 nt, Human
uugagcccaggaguucaaggcuucagugagcc

SEQ ID NO: 539831 - RNA, 32 nt, Human
uugagcccaggaguucagggcugcagugagcc

SEQ ID NO: 539832 - RNA, 32 nt, Human
uugagcccaggaguucagggcugcagugaggu

SEQ ID NO: 539833 - RNA, 32 nt, Human
uugagcccaggaguuccagaccagccuaggca

SEQ ID NO: 539834 - RNA, 32 nt, Human
uugagcccaggaguuccagaccagccugggca

SEQ ID NO: 539835 - RNA, 32 nt, Human
uugagcccaggaguucgaagcugcagggaccu

SEQ ID NO: 539836 - RNA, 32 nt, Human
uugagcccaggaguucgacaccagccuggcca

SEQ ID NO: 539837 - RNA, 32 nt, Human
uugagcccaggaguucgagaccagccggggca

SEQ ID NO: 539838 - RNA, 32 nt, Human
uugagcccaggaguucgagaccagccugaaca

SEQ ID NO: 539839 - RNA, 32 nt, Human
uugagcccaggaguucgagaccagccuggaca

SEQ ID NO: 539840 - RNA, 32 nt, Human
uugagcccaggaguucgagaccagccugggca

SEQ ID NO: 539841 - RNA, 32 nt, Human
uugagcccaggaguucgagaccagcuugggca

SEQ ID NO: 539842 - RNA, 32 nt, Human
uugagcccaggaguucgaggcugcagcgagcc

SEQ ID NO: 539843 - RNA, 32 nt, Human
uugagcccaggaguucgaggcugcagucaguc

SEQ ID NO: 539844 - RNA, 32 nt, Human
uugagcccaggaguucgaggcugcagugagcu

SEQ ID NO: 539845 - RNA, 32 nt, Human
uugagcccaggaguucgagguuacagugaacu

SEQ ID NO: 539846 - RNA, 32 nt, Human
uugagcccaggaguucgauaccagccugggca

SEQ ID NO: 539847 - RNA, 32 nt, Human
uugagcccaggaguucgggaccagccugggaa

SEQ ID NO: 539848 - RNA, 32 nt, Human
uugagcccaggaguucugggcuguagugcacu

SEQ ID NO: 539849 - RNA, 32 nt, Human
uugagcccaggaguugaagaccagccugggca

SEQ ID NO: 539850 - RNA, 32 nt, Human
uugagcccaggaguuggagaccagccuggaua

SEQ ID NO: 539851 - RNA, 32 nt, Human
uugagcccaggaguuggaggccacagugagcu

SEQ ID NO: 539852 - RNA, 32 nt, Human
uugagcccaggaguuggaggccgcagugagcu

SEQ ID NO: 539853 - RNA, 32 nt, Human
uugagcccaggaguuuaaagcugcagugcccu

SEQ ID NO: 539854 - RNA, 32 nt, Human
uugagcccaggaguuuaagaccagccugggca

SEQ ID NO: 539855 - RNA, 32 nt, Human
uugagcccaggaguuuaagguuguagugcgcu

SEQ ID NO: 539856 - RNA, 32 nt, Human
uugagcccaggaguuugaaaccagccugggca

SEQ ID NO: 539857 - RNA, 32 nt, Human
uugagcccaggaguuugaaaccagccugggua

SEQ ID NO: 539858 - RNA, 32 nt, Human
uugagcccaggaguuugaagcugcagugagcu

SEQ ID NO: 539859 - RNA, 32 nt, Human
uugagcccaggaguuugacaccagccugggca

SEQ ID NO: 539860 - RNA, 32 nt, Human
uugagcccaggaguuugagaccagcauggaaa

SEQ ID NO: 539861 - RNA, 32 nt, Human
uugagcccaggaguuugagaccagccagggca

SEQ ID NO: 539862 - RNA, 32 nt, Human
uugagcccaggaguuugagaccagccuaggca

SEQ ID NO: 539863 - RNA, 32 nt, Human
uugagcccaggaguuugagaccagccuggaca

SEQ ID NO: 539864 - RNA, 32 nt, Human
uugagcccaggaguuugagaccagccuggcca

SEQ ID NO: 539865 - RNA, 32 nt, Human
uugagcccaggaguuugagaccagccugggca

SEQ ID NO: 539866 - RNA, 32 nt, Human
uugagcccaggaguuugagaccagccugggua

SEQ ID NO: 539867 - RNA, 32 nt, Human
uugagcccaggaguuugagaccagcuggggca

SEQ ID NO: 539868 - RNA, 32 nt, Human
uugagcccaggaguuugagaccaggcuaggca

SEQ ID NO: 539869 - RNA, 32 nt, Human
uugagcccaggaguuugagacuguagugcacu

SEQ ID NO: 539870 - RNA, 32 nt, Human
uugagcccaggaguuugagccuucagugagcu

SEQ ID NO: 539871 - RNA, 32 nt, Human
uugagcccaggaguuugaggaugcagugagcu

SEQ ID NO: 539872 - RNA, 32 nt, Human
uugagcccaggaguuugaggccagacugcaca

SEQ ID NO: 539873 - RNA, 32 nt, Human
uugagcccaggaguuugaggccagccugggca

SEQ ID NO: 539874 - RNA, 32 nt, Human
uugagcccaggaguuugaggcuacagugagcu

SEQ ID NO: 539875 - RNA, 32 nt, Human
uugagcccaggaguuugaggcugcagugaacu

SEQ ID NO: 539876 - RNA, 32 nt, Human
uugagcccaggaguuugaggcugcagugagcc

SEQ ID NO: 539877 - RNA, 32 nt, Human
uugagcccaggaguuugaggcugcagugagcu

SEQ ID NO: 539878 - RNA, 32 nt, Human
uugagcccaggaguuugaggcugcagugaguu

SEQ ID NO: 539879 - RNA, 32 nt, Human
uugagcccaggaguuugaggcugcggugagcu

SEQ ID NO: 539880 - RNA, 32 nt, Human
uugagcccaggaguuugagggcagccugggaa

SEQ ID NO: 539881 - RNA, 32 nt, Human
uugagcccaggaguuugagguugcagugagcu

SEQ ID NO: 539882 - RNA, 32 nt, Human
uugagcccaggaguuugagguugcagugcacu

SEQ ID NO: 539883 - RNA, 32 nt, Human
uugagcccaggaguuugagguuguagggagcu

SEQ ID NO: 539884 - RNA, 32 nt, Human
uugagcccaggaguuugcgaccagccugggca

SEQ ID NO: 539885 - RNA, 32 nt, Human
uugagcccaggcccacugggacaggguccuca

SEQ ID NO: 539886 - RNA, 32 nt, Human
uugagcccaggccucugguugcaggacucgug

SEQ ID NO: 539887 - RNA, 32 nt, Human
uugagcccaggcgguugaggcugcagugagcc

SEQ ID NO: 539888 - RNA, 32 nt, Human
uugagcccaggcguucaagaccagccugggca

SEQ ID NO: 539889 - RNA, 32 nt, Human
uugagcccagggaggcagagguugcuguaagu

SEQ ID NO: 539890 - RNA, 32 nt, Human
uugagcccagggguucaagaccaaucugggca

SEQ ID NO: 539891 - RNA, 32 nt, Human
uugagcccagggguucgagaccagcuugagca

SEQ ID NO: 539892 - RNA, 32 nt, Human
uugagcccagggguuugagaccagcuugggca

SEQ ID NO: 539893 - RNA, 32 nt, Human
uugagcccagggguuugaggcugcagugagcc

SEQ ID NO: 539894 - RNA, 32 nt, Human
uugagcccaguaggucgaggcugcagugagcu

SEQ ID NO: 539895 - RNA, 32 nt, Human
uugagcccaguaguuugaggcugcagcgaggg

SEQ ID NO: 539896 - RNA, 32 nt, Human
uugagcccaguauuucaagaccagccuaaagg

SEQ ID NO: 539897 - RNA, 32 nt, Human
uugagcccaugagauugaggcugcagugagcu

SEQ ID NO: 539898 - RNA, 32 nt, Human
uugagcccaugaguucaaggcugcagugaguc

SEQ ID NO: 539899 - RNA, 32 nt, Human
uugagcccaugaguuugagaccagccugggua

SEQ ID NO: 539900 - RNA, 32 nt, Human
uugagccccagaggucaaggcugcagugagcu

SEQ ID NO: 539901 - RNA, 32 nt, Human
uugagccccagaguucaagaccagccugggca

SEQ ID NO: 539902 - RNA, 32 nt, Human
uugagccccagggguggaggcugcaaugaacu

SEQ ID NO: 539903 - RNA, 32 nt, Human
uugagccccggaggucgaggcuacagugaccc

SEQ ID NO: 539904 - RNA, 32 nt, Human
uugagccccggaggucgaggcugcagugggcu

SEQ ID NO: 539905 - RNA, 32 nt, Human
uugagccccuuguucauucuccuuccuuuuuc

SEQ ID NO: 539906 - RNA, 32 nt, Human
uugagcccggaaguucgagaccagcuuugggc

SEQ ID NO: 539907 - RNA, 32 nt, Human
uugagcccgggaggcagaggcugcagugaacc

SEQ ID NO: 539908 - RNA, 32 nt, Human
uugagcccgggaggcggagguugcagugagcu

SEQ ID NO: 539909 - RNA, 32 nt, Human
uugagcccgggaggucaagguugcagugaguc

SEQ ID NO: 539910 - RNA, 32 nt, Human
uugagcccgggaggucgaggcuacaguaagcu

SEQ ID NO: 539911 - RNA, 32 nt, Human
uugagcccgggagguugaggcugcaguggggg

SEQ ID NO: 539912 - RNA, 32 nt, Human
uugagcccgugaagucgaggcugcagugagcc

SEQ ID NO: 539913 - RNA, 32 nt, Human
uugagcccuagaggucgaggcugcagugagcu

SEQ ID NO: 539914 - RNA, 32 nt, Human
uugagcccuagagguugaggcugcagugagcu

SEQ ID NO: 539915 - RNA, 32 nt, Human
uugagcccuggagaucgaggcugcaguaagcc

SEQ ID NO: 539916 - RNA, 32 nt, Human
uugagcccuggaggucaaggcugcagugagcc

SEQ ID NO: 539917 - RNA, 32 nt, Human
uugagcccuggagguugaggcugcagugagcu

SEQ ID NO: 539918 - RNA, 32 nt, Human
uugagcccuggaguucaaggcugcagugagcu

SEQ ID NO: 539919 - RNA, 32 nt, Human
uugagcccuuugucccaucccagagcucagag

SEQ ID NO: 539920 - RNA, 32 nt, Human
uugagccgaggaguucaagaccagccugggua

SEQ ID NO: 539921 - RNA, 32 nt, Human
uugagccgaggaguucgagaccagccugggca

SEQ ID NO: 539922 - RNA, 32 nt, Human
uugagccgaggggguggggguugcagugagcc

SEQ ID NO: 539923 - RNA, 32 nt, Human
uugagccgccggccucggccucccaggaagug

SEQ ID NO: 539924 - RNA, 32 nt, Human
uugagccggggagguggaggcugcagugaacu

SEQ ID NO: 539925 - RNA, 32 nt, Human
uugagccuaagagaucaaggcugcagugagcc

SEQ ID NO: 539926 - RNA, 32 nt, Human
uugagccuaagcagucgcggcugcagugaaca

SEQ ID NO: 539927 - RNA, 31 nt, Human
uugagccuacucuugauucaugcagagugcc

SEQ ID NO: 539928 - RNA, 32 nt, Human
uugagccuagaaguucaagaccagccugggca

SEQ ID NO: 539929 - RNA, 32 nt, Human
uugagccuagacguuaaagaccagccugggca

SEQ ID NO: 539930 - RNA, 32 nt, Human
uugagccuagcaguucgagaccagccugggca

SEQ ID NO: 539931 - RNA, 32 nt, Human
uugagccuaggaagucgaggcugcagugagcu

SEQ ID NO: 539932 - RNA, 32 nt, Human
uugagccuaggaauucaagaccagccuaggua

SEQ ID NO: 539933 - RNA, 32 nt, Human
uugagccuaggaggucaaggcugcagugagcc

SEQ ID NO: 539934 - RNA, 32 nt, Human
uugagccuaggaggucgaggcugcagugggau

SEQ ID NO: 539935 - RNA, 32 nt, Human
uugagccuaggagguugaggcugcagugagcu

SEQ ID NO: 539936 - RNA, 32 nt, Human
uugagccuaggaguucgagaccagccuaggca

SEQ ID NO: 539937 - RNA, 32 nt, Human
uugagccuaggaguucgagaccagccugggca

SEQ ID NO: 539938 - RNA, 32 nt, Human
uugagccuaggaguucgagaccagcuuaggca

SEQ ID NO: 539939 - RNA, 32 nt, Human
uugagccuaggaguuuaagaccagccugggca

SEQ ID NO: 539940 - RNA, 32 nt, Human
uugagccuaugaguucaagaccagccuaggca

SEQ ID NO: 539941 - RNA, 32 nt, Human
uugagccuauuaguuggaggcugcaguaagcu

SEQ ID NO: 539942 - RNA, 32 nt, Human
uugagccucuuggaggauggugggagaagugc

SEQ ID NO: 539943 - RNA, 32 nt, Human
uugagccugagaguuugagaccagcccaggca

SEQ ID NO: 539944 - RNA, 32 nt, Human
uugagccugaguucaacacugcagugagcuau

SEQ ID NO: 539945 - RNA, 32 nt, Human
uugagccugcagcagcugcaguaagccaagau

SEQ ID NO: 539946 - RNA, 32 nt, Human
uugagccugcagcucuguaaccacagggcucc

SEQ ID NO: 539947 - RNA, 32 nt, Human
uugagccugcaucuucuugcaucuaaugaaaa

SEQ ID NO: 539948 - RNA, 32 nt, Human
uugagccugcuggccucuugaccucugacccc

SEQ ID NO: 539949 - RNA, 32 nt, Human
uugagccuggaaaagguugcagugagcuggaa

SEQ ID NO: 539950 - RNA, 32 nt, Human
uugagccugggaaguggaggcugcagugagcc

SEQ ID NO: 539951 - RNA, 32 nt, Human
uugagccugggacauugaggcugcagugaacu

SEQ ID NO: 539952 - RNA, 32 nt, Human
uugagccugggagaucgaggcugcagugagcc

SEQ ID NO: 539953 - RNA, 32 nt, Human
uugagccugggagcaaggguugcagugagcug

SEQ ID NO: 539954 - RNA, 32 nt, Human
uugagccugggagcgcagguugcaaugagcca

SEQ ID NO: 539955 - RNA, 32 nt, Human
uugagccugggaggcagaggcugcagugagcc

SEQ ID NO: 539956 - RNA, 32 nt, Human
uugagccugggaggucaaggcugcaguaagcu

SEQ ID NO: 539957 - RNA, 32 nt, Human
uugagccugggaggucaaggcugcagugaacc

SEQ ID NO: 539958 - RNA, 32 nt, Human
uugcgccacuacacuccagccugggugacaga

SEQ ID NO: 539959 - RNA, 32 nt, Human
uugcgccacuacacucuagccugggcaacgag

SEQ ID NO: 539960 - RNA, 32 nt, Human
uugcgccacugcaaaccagccugggcaauaga

SEQ ID NO: 539961 - RNA, 32 nt, Human
uugcgccacugcacaccagucuggagacagag

SEQ ID NO: 539962 - RNA, 32 nt, Human
uugcgccacugcacacuagcuugggugacaga

SEQ ID NO: 539963 - RNA, 32 nt, Human
uugcgccacugcaccccagcaugagcgacaga

SEQ ID NO: 539964 - RNA, 32 nt, Human
uugcgccacugcaccccagcccagugacaggg

SEQ ID NO: 539965 - RNA, 32 nt, Human
uugcgccacugcaccccagcccgggugacaga

SEQ ID NO: 539966 - RNA, 32 nt, Human
uugcgccacugcaccccagccuggacaacaga

SEQ ID NO: 539967 - RNA, 32 nt, Human
uugcgccacugcaccccagccugggcgacaga

SEQ ID NO: 539968 - RNA, 32 nt, Human
uugcgccacugcaccccagccugggugacaga

SEQ ID NO: 539969 - RNA, 32 nt, Human
uugcgccacugcacucaagucugggcgacagg

SEQ ID NO: 539970 - RNA, 32 nt, Human
uugcgccacugcacuccaaccugggcaauaga

SEQ ID NO: 539971 - RNA, 32 nt, Human
uugcgccacugcacuccacccugggugacaga

SEQ ID NO: 539972 - RNA, 32 nt, Human
uugcgccacugcacuccagccagggcgaagga

SEQ ID NO: 539973 - RNA, 32 nt, Human
uugcgccacugcacuccagcccuggcgacaga

SEQ ID NO: 539974 - RNA, 32 nt, Human
uugcgccacugcacuccagccuaggugauaga

SEQ ID NO: 539975 - RNA, 32 nt, Human
uugcgccacugcacuccagccugacgacaaag

SEQ ID NO: 539976 - RNA, 32 nt, Human
uugcgccacugcacuccagccugagcgacaga

SEQ ID NO: 539977 - RNA, 32 nt, Human
uugcgccacugcacuccagccuggcgacagag

SEQ ID NO: 539978 - RNA, 32 nt, Human
uugcgccacugcacuccagccugggagacaga

SEQ ID NO: 539979 - RNA, 32 nt, Human
uugcgccacugcacuccagccugggcaacaag

SEQ ID NO: 539980 - RNA, 32 nt, Human
uugcgccacugcacuccagccugggcaacaga

SEQ ID NO: 539981 - RNA, 32 nt, Human
uugcgccacugcacuccagccugggcaauaga

SEQ ID NO: 539982 - RNA, 32 nt, Human
uugcgccacugcacuccagccugggcagcaga

SEQ ID NO: 539983 - RNA, 32 nt, Human
uugcgccacugcacuccagccugggcgacaga

SEQ ID NO: 539984 - RNA, 32 nt, Human
uugcgccacugcacuccagccugggcgacgga

SEQ ID NO: 539985 - RNA, 32 nt, Human
uugcgccacugcacuccagccugggcuacaga

SEQ ID NO: 539986 - RNA, 32 nt, Human
uugcgccacugcacuccagccugggggacaga

SEQ ID NO: 539987 - RNA, 32 nt, Human
uugcgccacugcacuccagccuggguaacaga

SEQ ID NO: 539988 - RNA, 32 nt, Human
uugcgccacugcacuccagccugggugacaga

SEQ ID NO: 539989 - RNA, 32 nt, Human
uugcgccacugcacuccagccugggugacuga

SEQ ID NO: 539990 - RNA, 32 nt, Human
uugcgccacugcacuccagccugguugacaga

SEQ ID NO: 539991 - RNA, 32 nt, Human
uugcgccacugcacuccagcgcggaagacaga

SEQ ID NO: 539992 - RNA, 32 nt, Human
uugcgccacugcacuccagcgugggcuacaga

SEQ ID NO: 539993 - RNA, 32 nt, Human
uugcgccacugcacuccagucugggcgacaga

SEQ ID NO: 539994 - RNA, 32 nt, Human
uugcgccacugcacuccagucuggucggcaag

SEQ ID NO: 539995 - RNA, 32 nt, Human
uugcgccacugcacucuagccuaagcaaugga

SEQ ID NO: 539996 - RNA, 32 nt, Human
uugcgccacugcacucuagccugggcuacaga

SEQ ID NO: 539997 - RNA, 32 nt, Human
uugcgccacugcacuucagccuggaugacaga

SEQ ID NO: 539998 - RNA, 32 nt, Human
uugcgccacugcacuucagccugggcaacaga

SEQ ID NO: 539999 - RNA, 32 nt, Human
uugcgccacugcaguccgcagcccagccuggg

SEQ ID NO: 540000 - RNA, 32 nt, Human
uugcgccacugcaguccgcaguccagccuggg

SEQ ID NO: 540001 - RNA, 32 nt, Human
uugcgccacugcaguccgcaguccggccuggg

SEQ ID NO: 540002 - RNA, 32 nt, Human
uugcgccacugcaguccgcagucuggccuggg

SEQ ID NO: 540003 - RNA, 32 nt, Human
uugcgccacugcauuccagccugggugacuga

SEQ ID NO: 540004 - RNA, 32 nt, Human
uugcgccacugcauuccagcuugggcgacaga

SEQ ID NO: 540005 - RNA, 32 nt, Human
uugcgccacugcauucuagccugagugacaga

SEQ ID NO: 540006 - RNA, 32 nt, Human
uugcgccacugcauucuagccuggaugacaga

SEQ ID NO: 540007 - RNA, 32 nt, Human
uugcgccacugcgcuccagccugggcaacaga

SEQ ID NO: 540008 - RNA, 32 nt, Human
uugcgccacuggacuccagccugcgugacaga

SEQ ID NO: 540009 - RNA, 32 nt, Human
uugcgccacuguacuccagccuggcaacagag

SEQ ID NO: 540010 - RNA, 32 nt, Human
uugcgccacuguacuccagccugggugacgag

SEQ ID NO: 540011 - RNA, 32 nt, Human
uugcgccacuguacuccagccugggugaggag

SEQ ID NO: 540012 - RNA, 32 nt, Human
uugcgccacuguacuccagcuugggcaacaga

SEQ ID NO: 540013 - RNA, 32 nt, Human
uugcgccacuguacuccaguuuggacuacaga

SEQ ID NO: 540014 - RNA, 32 nt, Human
uugcgccacuucacuccagccugggugacaga

SEQ ID NO: 540015 - RNA, 32 nt, Human
uugcgccagcgggaaccacuaucucugcacuc

SEQ ID NO: 540016 - RNA, 32 nt, Human
uugcgccagugcacuccagcugggcgacagag

SEQ ID NO: 540017 - RNA, 32 nt, Human
uugcgccaugucuccucggggccggcgguugc

SEQ ID NO: 540018 - RNA, 32 nt, Human
uugcgccauugcacuccagccuagguaacaag

SEQ ID NO: 540019 - RNA, 32 nt, Human
uugcgccauugcacuccagccugggcaaaaag

SEQ ID NO: 540020 - RNA, 32 nt, Human
uugcgccauugcacuccagccugggcaacaag

SEQ ID NO: 540021 - RNA, 32 nt, Human
uugcgccauugcacuccagccugggcaacaca

SEQ ID NO: 540022 - RNA, 32 nt, Human
uugcgccauugcacuccagccugggcaacaga

SEQ ID NO: 540023 - RNA, 32 nt, Human
uugcgccauugcacuccagccugggcaacgag

SEQ ID NO: 540024 - RNA, 32 nt, Human
uugcgccauugcacuccagccuggggacaaag

SEQ ID NO: 540025 - RNA, 32 nt, Human
uugcgccauugcacuuaagccuagagacaaga

SEQ ID NO: 540026 - RNA, 32 nt, Human
uugcgccauugcauuccagccugggcaacaag

SEQ ID NO: 540027 - RNA, 32 nt, Human
uugcgccauugcauuccagccugggugacaga

SEQ ID NO: 540028 - RNA, 32 nt, Human
uugcgccauuguacuccagccugggcaacaag

SEQ ID NO: 540029 - RNA, 32 nt, Human
uugcgccauuguacuccagccugggggacagg

SEQ ID NO: 540030 - RNA, 32 nt, Human
uugcgccauugugcuccagccugggugacaaa

SEQ ID NO: 540031 - RNA, 32 nt, Human
uugcgcccccuccccaugaucucccuuuccag

SEQ ID NO: 540032 - RNA, 32 nt, Human
uugcgcccccugcacuccagccugggcuucag

SEQ ID NO: 540033 - RNA, 32 nt, Human
uugcgccccugcacuccaaccuggacaacaca

SEQ ID NO: 540034 - RNA, 32 nt, Human
uugcgccccugccuccuugccaggcucuuccu

SEQ ID NO: 540035 - RNA, 32 nt, Human
uugcgcccuuucucucccucuuggugccccug

SEQ ID NO: 540036 - RNA, 32 nt, Human
uugcgccgcuacauuccagccugggcaacacg

SEQ ID NO: 540037 - RNA, 32 nt, Human
uugcgccgcugcacuccagccugggcaacaga

SEQ ID NO: 540038 - RNA, 32 nt, Human
uugcgccgcugcacuccagccugggcgacaga

SEQ ID NO: 540039 - RNA, 32 nt, Human
uugcgccguuguacuccagccugggcaacaga

SEQ ID NO: 540040 - RNA, 32 nt, Human
uugcgccugcagucccagcuacuugggaggcc

SEQ ID NO: 540041 - RNA, 32 nt, Human
uugcgccuguaaucccagccacucgagaauca

SEQ ID NO: 540042 - RNA, 32 nt, Human
uugcgcgcacacacacauacaagcgggcacga

SEQ ID NO: 540043 - RNA, 32 nt, Human
uugcgcggagagugggcuugacugggcagagc

SEQ ID NO: 540044 - RNA, 32 nt, Human
uugcgcuacuacgcuacagccugggugacagc

SEQ ID NO: 540045 - RNA, 32 nt, Human
uugcgcuacugaacuccagccuggguuacaga

SEQ ID NO: 540046 - RNA, 32 nt, Human
uugcgcuacugcaaucccaccugggcaacaag

SEQ ID NO: 540047 - RNA, 32 nt, Human
uugcgcuacugcacuccagccuaggcaacaga

SEQ ID NO: 540048 - RNA, 32 nt, Human
uugcgcuacugcacuccagccuggacaacaga

SEQ ID NO: 540049 - RNA, 32 nt, Human
uugcgcuacugcacuccagccugggcgacagu

SEQ ID NO: 540050 - RNA, 32 nt, Human
uugcgcuacugcacuccagccugggugacaga

SEQ ID NO: 540051 - RNA, 32 nt, Human
uugcgcucacacuuaagcgucugugacaggag

SEQ ID NO: 540052 - RNA, 32 nt, Human
uugcgcugcugcacuccaaccugggcgacaga

SEQ ID NO: 540053 - RNA, 32 nt, Human
uugcgcuguguaacugcugccagcuucucucu

SEQ ID NO: 540054 - RNA, 32 nt, Human
uugcgcuucagccugggcaacaagagugaaac

SEQ ID NO: 540055 - RNA, 32 nt, Human
uugcgcuucuuggauuuuccaaaggaggugac

SEQ ID NO: 540056 - RNA, 32 nt, Human
uugcggaaagcaucuaggcugaagggugcagg

SEQ ID NO: 540057 - RNA, 32 nt, Human
uugcggacagugcgugagaaaccagcaccccc

SEQ ID NO: 540058 - RNA, 32 nt, Human
uugcggaccaguacuuguuuguccuuaaauac

SEQ ID NO: 540059 - RNA, 32 nt, Human
uugcggacuggccuuguccugaguggccuuag

SEQ ID NO: 540060 - RNA, 18 nt, Human
uugcggagggugcgcuca

SEQ ID NO: 540061 - RNA, 17 nt, Human
uugcggaugcugaugca

SEQ ID NO: 540062 - RNA, 17 nt, Human
uugcggauugccgugca

SEQ ID NO: 540063 - RNA, 32 nt, Human
uugcggcacaaguaccucaucaacuucuaucg

SEQ ID NO: 540064 - RNA, 31 nt, Human
uugcggcacagcuagggcaucccggcgagga

SEQ ID NO: 540065 - RNA, 24 nt, Human
uugcggcauccacgagaccaccuu

SEQ ID NO: 540066 - RNA, 32 nt, Human
uugcggccacacacaacacgcaagcacgccuu

SEQ ID NO: 540067 - RNA, 32 nt, Human
uugcggccccaucagcgaaaaggaggggaggg

SEQ ID NO: 540068 - RNA, 32 nt, Human
uugcggccgcgauucuuccagcaagggauuca

SEQ ID NO: 540069 - RNA, 32 nt, Human
uugcggccuccuggcccggugcagcugcccuc

SEQ ID NO: 540070 - RNA, 25 nt, Human
uugcggccugcccuucaccuccucu

SEQ ID NO: 540071 - RNA, 32 nt, Human
uugcggcggccgcggcagcaugguggugccgg

SEQ ID NO: 540072 - RNA, 32 nt, Human
uugcggcugcagaggacuuccccaaauuuugc

SEQ ID NO: 540073 - RNA, 32 nt, Human
uugcggcuggacgcccagccuggugugcugag

SEQ ID NO: 540074 - RNA, 32 nt, Human
uugcggcugggaagagcggcgagaggguucgg

SEQ ID NO: 540075 - RNA, 32 nt, Human
uugcggcugggcccggggagcagugaguggaa

SEQ ID NO: 540076 - RNA, 32 nt, Human
uugcgggacagaaucagaggacauacaugauu

SEQ ID NO: 540077 - RNA, 32 nt, Human
uugcgggagugaagucccuuggggaggguugc

SEQ ID NO: 540078 - RNA, 32 nt, Human
uugcgggcagucuccccucuccaggccgaggc

SEQ ID NO: 540079 - RNA, 32 nt, Human
uugcgggcaguggacgcgguucugccgagagc

SEQ ID NO: 540080 - RNA, 32 nt, Human
uugcggggagacagcucucucucccaccuccu

SEQ ID NO: 540081 - RNA, 32 nt, Human
uugcggggagagaggucagagccagaugaaaa

SEQ ID NO: 540082 - RNA, 32 nt, Human
uugcggggaggugcggagggagaggggcgggc

SEQ ID NO: 540083 - RNA, 32 nt, Human
uugcgggggauguggaggaaaauuaccaacuu

SEQ ID NO: 540084 - RNA, 32 nt, Human
uugcggggugggagaauguggggugaggguuc

SEQ ID NO: 540085 - RNA, 18 nt, Human
uugcggguggaacaguca

SEQ ID NO: 540086 - RNA, 17 nt, Human
uugcggguucuacauca

SEQ ID NO: 540087 - RNA, 32 nt, Human
uugcggucagggacugaaucuugcccguuuau

SEQ ID NO: 540088 - RNA, 32 nt, Human
uugcggugcagacccucucaggagcaggaaga

SEQ ID NO: 540089 - RNA, 32 nt, Human
uugcggugcucggucgccgccuaggcggggca

SEQ ID NO: 540090 - RNA, 32 nt, Human
uugcgguggcaugacugucaggaggugcuggc

SEQ ID NO: 540091 - RNA, 32 nt, Human
uugcggugguggucgagggaaaaccacugccg

SEQ ID NO: 540092 - RNA, 32 nt, Human
uugcgguuccgaggcagugggaagagaugcgg

SEQ ID NO: 540093 - RNA, 32 nt, Human
uugcguacacagagaaggcuauguaaacaaac

SEQ ID NO: 540094 - RNA, 32 nt, Human
uugcguagcccugggagccaccuugcuucugg

SEQ ID NO: 540095 - RNA, 32 nt, Human
uugcguagcuucaaaaaggcguaacagugacc

SEQ ID NO: 540096 - RNA, 32 nt, Human
uugcgucacugaacuccggccugggugacaga

SEQ ID NO: 540097 - RNA, 32 nt, Human
uugcgucacugcacuccaaccugggugacaga

SEQ ID NO: 540098 - RNA, 32 nt, Human
uugcgucacugcacuccagccugagcaacaga

SEQ ID NO: 540099 - RNA, 32 nt, Human
uugcgucacugcacuccagccugggcgacaga

SEQ ID NO: 540100 - RNA, 32 nt, Human
uugcgucacugcacugcagccugggugacaga

SEQ ID NO: 540101 - RNA, 32 nt, Human
uugcgucccuuggacugccuguugauugaugg

SEQ ID NO: 540102 - RNA, 32 nt, Human
uugcguccucaccucucacccucuccuucccg

SEQ ID NO: 540103 - RNA, 32 nt, Human
uugcguccuuucucuucuccgccauggaauuc

SEQ ID NO: 540104 - RNA, 32 nt, Human
uugcgucuuagcagugauuuuuauccaaucuu

SEQ ID NO: 540105 - RNA, 32 nt, Human
uugcgugaugcugagguuuggggugcgaauga

SEQ ID NO: 540106 - RNA, 32 nt, Human
uugcgugcagccugugugugugcuggcacaag

SEQ ID NO: 540107 - RNA, 32 nt, Human
uugcgugccuguagucccagcuacuugggagg

SEQ ID NO: 540108 - RNA, 22 nt, Human
uugcguggggagacacagugga

SEQ ID NO: 540109 - RNA, 32 nt, Human
uugcguggggcauguaggugggggaggcgucu

SEQ ID NO: 540110 - RNA, 32 nt, Human
uugcguguccagccccuccagacaccaccacu

SEQ ID NO: 540111 - RNA, 32 nt, Human
uugcgugugguguucaggacuguuccuuggug

SEQ ID NO: 540112 - RNA, 32 nt, Human
uugcguuaucugcagugcggccugagguuacg

SEQ ID NO: 540113 - RNA, 32 nt, Human
uugcguugauacuuugccccagaaaggccugg

SEQ ID NO: 540114 - RNA, 32 nt, Human
uugcguugcucaaaucacuagcacagagguuc

SEQ ID NO: 540115 - RNA, 32 nt, Human
uugcguuggucugcggcguuuccccagcagac

SEQ ID NO: 540116 - RNA, 32 nt, Human
uugcuaaaaaggauuuucuuaacucagauuuu

SEQ ID NO: 540117 - RNA, 32 nt, Human
uugcuaaaaaguuauugaauacauuuguuucu

SEQ ID NO: 540118 - RNA, 32 nt, Human
uugcuaaaaccucaauuuaagucuuuaaaagg

SEQ ID NO: 540119 - RNA, 32 nt, Human
uugcuaaaagugaaagucaucuagcauucuua

SEQ ID NO: 540120 - RNA, 32 nt, Human
uugcuaaaccaaggaggcagaccucauguuug

SEQ ID NO: 540121 - RNA, 32 nt, Human
uugcuaaacccagagacacugcaccugaaucc

SEQ ID NO: 540122 - RNA, 32 nt, Human
uugcuaaaccucuccucugacugccuuuauua

SEQ ID NO: 540123 - RNA, 32 nt, Human
uugcuaaauuucuuaucuuuacacucuaaagc

SEQ ID NO: 540124 - RNA, 32 nt, Human
uugcuaaauuuguauucucugugaauuucacu

SEQ ID NO: 540125 - RNA, 32 nt, Human
uugcuaaauuuuucuuugagguucuccugaau

SEQ ID NO: 540126 - RNA, 32 nt, Human
uugcuaacagaaguggccuguaagcuccugug

SEQ ID NO: 540127 - RNA, 32 nt, Human
uugcuaacaggauaugggcuaccaggaagaag

SEQ ID NO: 540128 - RNA, 32 nt, Human
uugcuaacauggugaaaccccgucucuacuaa

SEQ ID NO: 540129 - RNA, 32 nt, Human
uugcuaacauguuuuuauuuuucacuguaaau

SEQ ID NO: 540130 - RNA, 32 nt, Human
uugcuaaccuaaaagacagcagggacaagaua

SEQ ID NO: 540131 - RNA, 32 nt, Human
uugcuaaccugacauuuacuucaauuuuucuu

SEQ ID NO: 540132 - RNA, 32 nt, Human
uugcuaacucuggauaacacuuggggacuuga

SEQ ID NO: 540133 - RNA, 32 nt, Human
uugcuaacuuaggguuuugagcagguuggggu

SEQ ID NO: 540134 - RNA, 32 nt, Human
uugcuaagaaagcaaugucuuccuucauccuu

SEQ ID NO: 540135 - RNA, 32 nt, Human
uugcuaagccaagaaggaacuuucccacacua

SEQ ID NO: 540136 - RNA, 32 nt, Human
uugcuaagguuuaggaaggcaaguaugauucu

SEQ ID NO: 540137 - RNA, 20 nt, Human
uugcuaaguguaacuguauc

SEQ ID NO: 540138 - RNA, 32 nt, Human
uugcuaaucugcuuugugugacagcauuccag

SEQ ID NO: 540139 - RNA, 32 nt, Human
uugcuacaaucuugaccccuuugcuacauucc

SEQ ID NO: 540140 - RNA, 32 nt, Human
uugcuacagagauguuuauucuaaauuuaaau

SEQ ID NO: 540141 - RNA, 32 nt, Human
uugcuacagcaaccccagcucugcaggguguc

SEQ ID NO: 540142 - RNA, 32 nt, Human
uugcuacaggaauggaauaagcuuaaacaugu

SEQ ID NO: 540143 - RNA, 32 nt, Human
uugcuacagguggguccagcugcccaggucau

SEQ ID NO: 540144 - RNA, 31 nt, Human
uugcuacaguauuucugacauuuagaguagu

SEQ ID NO: 540145 - RNA, 32 nt, Human
uugcuacaguuuaucuagguugcaguggcauc

SEQ ID NO: 540146 - RNA, 32 nt, Human
uugcuacauaagauugcaagacuugccaagaa

SEQ ID NO: 540147 - RNA, 32 nt, Human
uugcuaccagggaguauucuuuggauaagcaa

SEQ ID NO: 540148 - RNA, 32 nt, Human
uugcuaccauuucuagagagagaggacacagu

SEQ ID NO: 540149 - RNA, 21 nt, Human
uugcuacccuucggacaagug

SEQ ID NO: 540150 - RNA, 32 nt, Human
uugcuaccgagaagguuggagguggggaaggc

SEQ ID NO: 540151 - RNA, 32 nt, Human
uugcuaccugucaacaugaauguuucugugag

SEQ ID NO: 540152 - RNA, 32 nt, Human
uugcuacucgaaggugccagaaugacacaaag

SEQ ID NO: 540153 - RNA, 32 nt, Human
uugcuacugcuacugauuuuggaggaaauuuu

SEQ ID NO: 540154 - RNA, 32 nt, Human
uugcuacugcugugggggcaugugggugggua

SEQ ID NO: 540155 - RNA, 32 nt, Human
uugcuagagacagcguuucucuguguugauca

SEQ ID NO: 540156 - RNA, 32 nt, Human
uugcuagagacagggauucgccauguuggcca

SEQ ID NO: 540157 - RNA, 32 nt, Human
uugcuagagcugcggcauucuccugggucucg

SEQ ID NO: 540158 - RNA, 32 nt, Human
uugcuagaggggcacauggagugggacaggag

SEQ ID NO: 540159 - RNA, 32 nt, Human
uugcuagcaaggcugagcacuuuuccauguga

SEQ ID NO: 540160 - RNA, 32 nt, Human
uugcuagcaguggaagggucacagaccaaaca

SEQ ID NO: 540161 - RNA, 22 nt, Human
uugcuagcauguuaugauuuca

SEQ ID NO: 540162 - RNA, 32 nt, Human
uugcuagcucagugaggggaauucuuccagaa

SEQ ID NO: 540163 - RNA, 32 nt, Human
uugcuagcucccucccuccuccugggugcuga

SEQ ID NO: 540164 - RNA, 32 nt, Human
uugcuaggacagaaacuguaaaaagaaaguaa

SEQ ID NO: 540165 - RNA, 32 nt, Human
uugcuaggacucaugggggagcccccagcucu

SEQ ID NO: 540166 - RNA, 32 nt, Human
uugcuaggagaagggaagacgcccgagacgcu

SEQ ID NO: 540167 - RNA, 32 nt, Human
uugcuaggcccaccuuuggccucccagcggcu

SEQ ID NO: 540168 - RNA, 20 nt, Human
uugcuaggcuggagugcagu

SEQ ID NO: 540169 - RNA, 32 nt, Human
uugcuaggcuuagcgggucuggcugcuggggg

SEQ ID NO: 540170 - RNA, 32 nt, Human
uugcuagggacugauguuauguucgacucagc

SEQ ID NO: 540171 - RNA, 32 nt, Human
uugcuaggggcaggaucucauucaggcugccc

SEQ ID NO: 540172 - RNA, 32 nt, Human
uugcuaggggcccugaccuggggugucaugac

SEQ ID NO: 540173 - RNA, 32 nt, Human
uugcuaguaggugaggcgagucucuaacugau

SEQ ID NO: 540174 - RNA, 32 nt, Human
uugcuagucaggggcuugguucucccacuuac

SEQ ID NO: 540175 - RNA, 24 nt, Human
uugcuagucuacaaaacuaggaca

SEQ ID NO: 540176 - RNA, 32 nt, Human
uugcuagucugcuucugagccauugucauauc

SEQ ID NO: 540177 - RNA, 32 nt, Human
uugcuagugagcaagcuuggucaaaguguaug

SEQ ID NO: 540178 - RNA, 32 nt, Human
uugcuagugggaagaaaaauagcugagcuuuc

SEQ ID NO: 540179 - RNA, 32 nt, Human
uugcuagugucacccaggcuggagugcaguga

SEQ ID NO: 540180 - RNA, 32 nt, Human
uugcuaguguugcccaggcuggagugcagugg

SEQ ID NO: 540181 - RNA, 32 nt, Human
uugcuauaagccaaggcuacugagugauacug

SEQ ID NO: 540182 - RNA, 32 nt, Human
uugcuauauggaaggcacauuuuugcacuaua

SEQ ID NO: 540183 - RNA, 32 nt, Human
uugcuauauugcucggagguuugcuaaaacuc

SEQ ID NO: 540184 - RNA, 32 nt, Human
uugcuaucauuuaccauggauuuccuacauuu

SEQ ID NO: 540185 - RNA, 32 nt, Human
uugcuaucggugguagaaguguugccauucac

SEQ ID NO: 540186 - RNA, 32 nt, Human
uugcuaucugggcugaguggccagggccaucc

SEQ ID NO: 540187 - RNA, 32 nt, Human
uugcuaucuuuccucugcucauggcauauaaa

SEQ ID NO: 540188 - RNA, 32 nt, Human
uugcuaugucauuccaucuuuuggaaggcagu

SEQ ID NO: 540189 - RNA, 32 nt, Human
uugcuaugucuuuuuaaaugguccauuuucaa

SEQ ID NO: 540190 - RNA, 32 nt, Human
uugcuauucugcgcccccuccuaccuugcgcu

SEQ ID NO: 540191 - RNA, 32 nt, Human
uugcuauugaaggaagcagugauggugaauuu

SEQ ID NO: 540192 - RNA, 32 nt, Human
uugcuauuguguuauuuuacuacuucucucug

SEQ ID NO: 540193 - RNA, 32 nt, Human
uugcuauuuucaaaugagaaaaucaagcaaag

SEQ ID NO: 540194 - RNA, 32 nt, Human
uugcuauuuuuccucuucaauuuccuucaauc

SEQ ID NO: 540195 - RNA, 32 nt, Human
uugcucaaaauggaauuccucuaagaaucaag

SEQ ID NO: 540196 - RNA, 32 nt, Human
uugcucaagcaaccugcugccuccacccagag

SEQ ID NO: 540197 - RNA, 32 nt, Human
uugcucaagcuggucucaagcuccugggcuca

SEQ ID NO: 540198 - RNA, 32 nt, Human
uugcucaagugccagagguugggagaaggauu

SEQ ID NO: 540199 - RNA, 32 nt, Human
uugcucacacacccuucacugcucuguaccca

SEQ ID NO: 540200 - RNA, 32 nt, Human
uugcucacacccuugguguucaggugagccgg

SEQ ID NO: 540201 - RNA, 32 nt, Human
uugcucacaccuguaucccagcacuuugggag

SEQ ID NO: 540202 - RNA, 32 nt, Human
uugcucacaguuacucauaacuacccauugac

SEQ ID NO: 540203 - RNA, 32 nt, Human
uugcucacaguuauuacauacacaucagccau

SEQ ID NO: 540204 - RNA, 32 nt, Human
uugcucaccauugcguggcuccaggcucaugu

SEQ ID NO: 540205 - RNA, 32 nt, Human
uugcucacccagacaccaugugcaaugacauu

SEQ ID NO: 540206 - RNA, 32 nt, Human
uugcucaccucccucucucuugcuucauuugg

SEQ ID NO: 540207 - RNA, 32 nt, Human
uugcucaccuggccacugcugccuuauccauu

SEQ ID NO: 540208 - RNA, 32 nt, Human
uugcucacgccuguaaucccagaacuuuagga

SEQ ID NO: 540209 - RNA, 32 nt, Human
uugcucacgccuguaaucccagcacuuuggga

SEQ ID NO: 540210 - RNA, 32 nt, Human
uugcucacgccuguaaucccagcacuuuucag

SEQ ID NO: 540211 - RNA, 32 nt, Human
uugcucacucuauccuggauaggcacuuggga

SEQ ID NO: 540212 - RNA, 32 nt, Human
uugcucacugaaucuguuggggagaggucacc

SEQ ID NO: 540213 - RNA, 32 nt, Human
uugcucacugaggauguuggggaagggacgaa

SEQ ID NO: 540214 - RNA, 32 nt, Human
uugcucacugcaacauccaccucaugggcuca

SEQ ID NO: 540215 - RNA, 32 nt, Human
uugcucacugcaaccucugccacccggguuca

SEQ ID NO: 540216 - RNA, 32 nt, Human
uugcucacugcagugggcccagccuggucuag

SEQ ID NO: 540217 - RNA, 32 nt, Human
uugcucacuguagccucgaauuccugggcuca

SEQ ID NO: 540218 - RNA, 32 nt, Human
uugcucacugugguaauuaccaguguguuuau

SEQ ID NO: 540219 - RNA, 32 nt, Human
uugcucagagucccagguccuggccugacccu

SEQ ID NO: 540220 - RNA, 32 nt, Human
uugcucagcaccguuucuccaucaaugccgug

SEQ ID NO: 540221 - RNA, 32 nt, Human
uugcucagcugagugugggaacaguccagccc

SEQ ID NO: 540222 - RNA, 32 nt, Human
uugcucagcuucuggggaggccucagggagau

SEQ ID NO: 540223 - RNA, 32 nt, Human
uugcucaggaugucgacagcuguggcuuccuu

SEQ ID NO: 540224 - RNA, 21 nt, Human
uugcucaggcuggaguacagu

SEQ ID NO: 540225 - RNA, 24 nt, Human
uugcucaggcuggaguacaguggc

SEQ ID NO: 540226 - RNA, 21 nt, Human
uugcucaggcuggagugcagu

SEQ ID NO: 540227 - RNA, 22 nt, Human
uugcucaggcuggagugcagug

SEQ ID NO: 540228 - RNA, 32 nt, Human
uugcucaggcuggagugcaguggugugaucuc

SEQ ID NO: 540229 - RNA, 32 nt, Human
uugcucaggcuggauugcaguggcgugaucau

SEQ ID NO: 540230 - RNA, 32 nt, Human
uugcucaggcuggucugaaacuccuggccuga

SEQ ID NO: 540231 - RNA, 32 nt, Human
uugcucagggcagcuucugcccagggugggug

SEQ ID NO: 540232 - RNA, 32 nt, Human
uugcucagggcugucugugcugcuccucacca

SEQ ID NO: 540233 - RNA, 32 nt, Human
uugcucaguacaacagucuugcauucagcagg

SEQ ID NO: 540234 - RNA, 32 nt, Human
uugcucagugccugagauugaaaaagucaaca

SEQ ID NO: 540235 - RNA, 32 nt, Human
uugcucagugcugaagugggguucucauuccg

SEQ ID NO: 540236 - RNA, 32 nt, Human
uugcucaguggcucugagacuguggauguccu

SEQ ID NO: 540237 - RNA, 32 nt, Human
uugcucagugucuggcugcagagcagugggcc

SEQ ID NO: 540238 - RNA, 30 nt, Human
uugcucaguuucucaacagaaagacucaua

SEQ ID NO: 540239 - RNA, 32 nt, Human
uugcucaucucccaggagagucucguccaaag

SEQ ID NO: 540240 - RNA, 32 nt, Human
uugcucaucuuuaugccccagcacuagguacg

SEQ ID NO: 540241 - RNA, 32 nt, Human
uugcucaugccuauaaucccagcacuuuagga

SEQ ID NO: 540242 - RNA, 32 nt, Human
uugcucaugccugucaguaucagugcuuccau

SEQ ID NO: 540243 - RNA, 32 nt, Human
uugcucauggaguugcaguucuugccuaacag

SEQ ID NO: 540244 - RNA, 32 nt, Human
uugcuccacagcuguagcucugggcugacgcc

SEQ ID NO: 540245 - RNA, 32 nt, Human
uugcuccagaugagucagugaguggugaauga

SEQ ID NO: 540246 - RNA, 32 nt, Human
uugcuccagcccaggcuggagugcaguggcau

SEQ ID NO: 540247 - RNA, 32 nt, Human
uugcuccagcuggucucaaacugcugggcuua

SEQ ID NO: 540248 - RNA, 32 nt, Human
uugcuccaguauguguaccaucuuguaaauuc

SEQ ID NO: 540249 - RNA, 23 nt, Human
uugcuccaguuuuacuacuugca

SEQ ID NO: 540250 - RNA, 32 nt, Human
uugcuccaucauaucaagacaaacauguuaga

SEQ ID NO: 540251 - RNA, 32 nt, Human
uugcuccaucuauuauugcuucuccauccugg

SEQ ID NO: 540252 - RNA, 32 nt, Human
uugcuccauugcacuccagccugggcaacgag

SEQ ID NO: 540253 - RNA, 32 nt, Human
uugcuccauugcacuccagccugggcgauaga

SEQ ID NO: 540254 - RNA, 32 nt, Human
uugcucccaagaggaggagagggaggcugcag

SEQ ID NO: 540255 - RNA, 32 nt, Human
uugcucccagacccucugaucucccuccaaca

SEQ ID NO: 540256 - RNA, 32 nt, Human
uugcucccagccuggcuccaucagccuccagc

SEQ ID NO: 540257 - RNA, 23 nt, Human
uugcucccaggcuggaaugcagu

SEQ ID NO: 540258 - RNA, 24 nt, Human
uugcucccaggcuggaaugcagug

SEQ ID NO: 540259 - RNA, 32 nt, Human
uugcucccauccugagccuccucugccccugu

SEQ ID NO: 540260 - RNA, 32 nt, Human
uugcuccccauugccacccacagugcccggaa

SEQ ID NO: 540261 - RNA, 32 nt, Human
uugcuccccgcuguagcccacagccauaucug

SEQ ID NO: 540262 - RNA, 32 nt, Human
uugcuccccucccuuacuccucccucugcugc

SEQ ID NO: 540263 - RNA, 32 nt, Human
uugcuccccuggaagacaggagaagcugggga

SEQ ID NO: 540264 - RNA, 32 nt, Human
uugcucccuagccugcaaggcuagcuccccug

SEQ ID NO: 540265 - RNA, 32 nt, Human
uugcucccucagagguggaggugaggggaaag

SEQ ID NO: 540266 - RNA, 32 nt, Human
uugcucccuccuagcugggagugacggguggg

SEQ ID NO: 540267 - RNA, 32 nt, Human
uugcucccucuuuugaggguaaagcuacuguc

SEQ ID NO: 540268 - RNA, 32 nt, Human
uugcucccugcucuuucugccucugggcucau

SEQ ID NO: 540269 - RNA, 32 nt, Human
uugcucccugggaacauuguccuuuccccacg

SEQ ID NO: 540270 - RNA, 32 nt, Human
uugcucccuuucucucucuguccuucccuucc

SEQ ID NO: 540271 - RNA, 19 nt, Human
uugcuccgcgccugagcca

SEQ ID NO: 540272 - RNA, 32 nt, Human
uugcuccgggacugaagaaucuccucacgugg

SEQ ID NO: 540273 - RNA, 32 nt, Human
uugcuccguugccuagcuggagugcacgaucu

SEQ ID NO: 540274 - RNA, 24 nt, Human
uugcuccuagaauuuuugucuuca

SEQ ID NO: 540275 - RNA, 32 nt, Human
uugcuccucacccaggcuggaaugcaguggug

SEQ ID NO: 540276 - RNA, 32 nt, Human
uugcuccuccagggcagcaccaugcagccccu

SEQ ID NO: 540277 - RNA, 32 nt, Human
uugcuccuccauccucauucucucaccaccag

SEQ ID NO: 540278 - RNA, 18 nt, Human
uugcuccucugggacuuu

SEQ ID NO: 540279 - RNA, 18 nt, Human
uugcuccugaacaucucu

SEQ ID NO: 540280 - RNA, 32 nt, Human
uugcuccugcaaccaguaucuccuuggaauuc

SEQ ID NO: 540281 - RNA, 32 nt, Human
uugcuccuggaagcucuguccagggaauugcu

SEQ ID NO: 540282 - RNA, 32 nt, Human
uugcuccuggucucccgccucucccaggcgac

SEQ ID NO: 540283 - RNA, 32 nt, Human
uugcuccuguaauuuuggccuuucgagugccu

SEQ ID NO: 540284 - RNA, 22 nt, Human
uugcuccugucgcccaggcugg

SEQ ID NO: 540285 - RNA, 32 nt, Human
uugcuccugucgcccaggcuggagugcaaugg

SEQ ID NO: 540286 - RNA, 32 nt, Human
uugcuccuguucugucacuugucauggucuuu

SEQ ID NO: 540287 - RNA, 32 nt, Human
uugcuccuucaagggacauuuggccaagucug

SEQ ID NO: 540288 - RNA, 32 nt, Human
uugcuccuucucaccuccucucaggccuaucu

SEQ ID NO: 540289 - RNA, 32 nt, Human
uugcuccuugcucucccaggaucaauuguauc

SEQ ID NO: 540290 - RNA, 32 nt, Human
uugcucgagauggaucugcccgugggccccgg

SEQ ID NO: 540291 - RNA, 32 nt, Human
uugcucgcgcgacaaguaguugcugggacagc

SEQ ID NO: 540292 - RNA, 32 nt, Human
uugcucggcccaggucuguuucaggcaucuga

SEQ ID NO: 540293 - RNA, 32 nt, Human
uugcucggcguugaggcuguggggaagaugcc

SEQ ID NO: 540294 - RNA, 32 nt, Human
uugcucgucacccaggcuggagugcaauugug

SEQ ID NO: 540295 - RNA, 32 nt, Human
uugcucuaacccggcuacagaagugaccacag

SEQ ID NO: 540296 - RNA, 32 nt, Human
uugcucuaccuggccgguaggcugcuggcgcc

SEQ ID NO: 540297 - RNA, 32 nt, Human
uugcucuaccugugcaugaagcacuugacgga

SEQ ID NO: 540298 - RNA, 25 nt, Human
uugcucuagagagaagcaaguggug

SEQ ID NO: 540299 - RNA, 32 nt, Human
uugcucuaggagcugaguugcugguuuggaag

SEQ ID NO: 540300 - RNA, 21 nt, Human
uugcucuagggaagcagugcg

SEQ ID NO: 540301 - RNA, 32 nt, Human
uugcucucaaacuccugaccucaggugaucca

SEQ ID NO: 540302 - RNA, 32 nt, Human
uugcucuccagccugggcgacaagagcgaaac

SEQ ID NO: 540303 - RNA, 32 nt, Human
uugcucucccaggcuggagugcagugguguaa

SEQ ID NO: 540304 - RNA, 32 nt, Human
uugcucuccccucuucucaagugccuuaauag

SEQ ID NO: 540305 - RNA, 32 nt, Human
uugcucucccucccgcuuccucccucccaucu

SEQ ID NO: 540306 - RNA, 32 nt, Human
uugcucucccuugcucuuccccaaacugaaaa

SEQ ID NO: 540307 - RNA, 32 nt, Human
uugcucuccuccacaucagcucccucuccucc

SEQ ID NO: 540308 - RNA, 19 nt, Human
uugcucuccuucugaguca

SEQ ID NO: 540309 - RNA, 32 nt, Human
uugcucucgcccaggcuggagugcagugggug

SEQ ID NO: 540310 - RNA, 32 nt, Human
uugcucucggaggccagggaagaugguacuua

SEQ ID NO: 540311 - RNA, 32 nt, Human
uugcucucugaacaaaaauuaucuucaauuua

SEQ ID NO: 540312 - RNA, 32 nt, Human
uugcucucuggagcuuacuaugugcugguacu

SEQ ID NO: 540313 - RNA, 17 nt, Human
uugcucucuugggccuu

SEQ ID NO: 540314 - RNA, 32 nt, Human
uugcucucuuuaccagacaggcagcaggaguc

SEQ ID NO: 540315 - RNA, 32 nt, Human
uugcucucuuucucccuccccuaccagccuca

SEQ ID NO: 540316 - RNA, 32 nt, Human
uugcucugaaggaggagcaggugaaacaggug

SEQ ID NO: 540317 - RNA, 18 nt, Human
uugcucugaaucacugug

SEQ ID NO: 540318 - RNA, 32 nt, Human
uugcucugaccuccucugggcccugucgcccc

SEQ ID NO: 540319 - RNA, 24 nt, Human
uugcucugagacacaaagugugua

SEQ ID NO: 540320 - RNA, 32 nt, Human
uugcucugcaauauuuacuuuacccuguuaau

SEQ ID NO: 540321 - RNA, 23 nt, Human
uugcucugcuccucagccuugca

SEQ ID NO: 540322 - RNA, 32 nt, Human
uugcucuggagagucccugcagagccacuggc

SEQ ID NO: 540323 - RNA, 21 nt, Human
uugcucugggacaccucccug

SEQ ID NO: 540324 - RNA, 32 nt, Human
uugcucugggacuuuuaugcucccagaggccc

SEQ ID NO: 540325 - RNA, 32 nt, Human
uugcucugggagaaugcauucuaaauuauaug

SEQ ID NO: 540326 - RNA, 20 nt, Human
uugcucugggagacuuacug

SEQ ID NO: 540327 - RNA, 32 nt, Human
uugcucuggggaaagccagcugccaucaggug

SEQ ID NO: 540328 - RNA, 32 nt, Human
uugcucugguccaggagcccacgguggggugc

SEQ ID NO: 540329 - RNA, 19 nt, Human
uugcucugguggcacugug

SEQ ID NO: 540330 - RNA, 32 nt, Human
uugcucugguugcccaggcugggguacagugg

SEQ ID NO: 540331 - RNA, 32 nt, Human
uugcucugucaccaggccggagugcaguggug

SEQ ID NO: 540332 - RNA, 32 nt, Human
uugcucugucaccaggcuggagggcaguggcg

SEQ ID NO: 540333 - RNA, 32 nt, Human
uugcucugucaccaggcuggagugcagcggcg

SEQ ID NO: 540334 - RNA, 32 nt, Human
uugcucugucaccaggcuggagugcaguggag

SEQ ID NO: 540335 - RNA, 32 nt, Human
uugcucugucaccaggcuggagugcaguggca

SEQ ID NO: 540336 - RNA, 32 nt, Human
uugcucugucaccaggcuggagugcgguggca

SEQ ID NO: 540337 - RNA, 32 nt, Human
uugcucugucagagcacagaggaggcucauau

SEQ ID NO: 540338 - RNA, 32 nt, Human
uugcucugucaucaggcuggagugcaguggcg

SEQ ID NO: 540339 - RNA, 32 nt, Human
uugcucugucaucaggcuggagugcaguggcu

SEQ ID NO: 540340 - RNA, 32 nt, Human
uugcucugucaugcaggcuggagugcgguggu

SEQ ID NO: 540341 - RNA, 32 nt, Human
uugcucugucgccaaguuggagugcaauggug

SEQ ID NO: 540342 - RNA, 32 nt, Human
uugcucugucgccagacuggagugcaguggcg

SEQ ID NO: 540343 - RNA, 32 nt, Human
uugcucugucgccaggcuggagugcaauggcg

SEQ ID NO: 540344 - RNA, 32 nt, Human
uugcucugucgccaggcuggagugcaguggcg

SEQ ID NO: 540345 - RNA, 32 nt, Human
uugcucugugacccagguugcagugagccaag

SEQ ID NO: 540346 - RNA, 32 nt, Human
uugcucuguugccaaguuaagugcagugguau

SEQ ID NO: 540347 - RNA, 32 nt, Human
uugcucuguugcccagcuggagugcaguggug

SEQ ID NO: 540348 - RNA, 32 nt, Human
uugcucuguugccccaggcuggagugcagugg

SEQ ID NO: 540349 - RNA, 32 nt, Human
uugcucuguugccugggcuggagugcagugcc

SEQ ID NO: 540350 - RNA, 32 nt, Human
uugcucuguuguguccuguugccggcucuggc

SEQ ID NO: 540351 - RNA, 22 nt, Human
uugcucuguuuauuguaaugua

SEQ ID NO: 540352 - RNA, 22 nt, Human
uugcucuguuuugguaccugua

SEQ ID NO: 540353 - RNA, 32 nt, Human
uugcucuuaacuucaccgccuaacccaaaacc

SEQ ID NO: 540354 - RNA, 32 nt, Human
uugcucuuacccaggcugagugcaguggcaga

SEQ ID NO: 540355 - RNA, 32 nt, Human
uugcucuuauugcccaggcuggagugcagugg

SEQ ID NO: 540356 - RNA, 32 nt, Human
uugcucuuccuuccaagaaccuucgagaucug

SEQ ID NO: 540357 - RNA, 32 nt, Human
uugcucuuccuucugacuucuuccucauuucu

SEQ ID NO: 540358 - RNA, 32 nt, Human
uugcucuucucaucuuuuccaacaguguucuc

SEQ ID NO: 540359 - RNA, 32 nt, Human
uugcucuugcacuccauccuggacaacagagu

SEQ ID NO: 540360 - RNA, 32 nt, Human
uugcucuugcccaggcaggaguacaguagugc

SEQ ID NO: 540361 - RNA, 32 nt, Human
uugcucuugcugcccaggcuagagugcaaugg

SEQ ID NO: 540362 - RNA, 32 nt, Human
uugcucuuguaaguccuuccucuggggaagug

SEQ ID NO: 540363 - RNA, 32 nt, Human
uugcucuuguagcccaggcuggagugcaaugg

SEQ ID NO: 540364 - RNA, 32 nt, Human
uugcucuuguagcccaggcugggaugcaaugg

SEQ ID NO: 540365 - RNA, 32 nt, Human
uugcucuugucacccaggcuggagugcaaugg

SEQ ID NO: 540366 - RNA, 32 nt, Human
uugcucuugucacccaggcuggagugcagugg

SEQ ID NO: 540367 - RNA, 32 nt, Human
uugcucuugucgcccaggcuggagugcaaugg

SEQ ID NO: 540368 - RNA, 32 nt, Human
uugcucuugucgcccaggcuggagugcagugg

SEQ ID NO: 540369 - RNA, 32 nt, Human
uugcucuugucucccaggcuggagugcaguga

SEQ ID NO: 540370 - RNA, 32 nt, Human
uugcucuuguuacccaggcaggagugcagugg

SEQ ID NO: 540371 - RNA, 32 nt, Human
uugcucuuguuacccaggcuggagugcagugg

SEQ ID NO: 540372 - RNA, 32 nt, Human
uugcucuuguuccccaggcuggagugcaaugg

SEQ ID NO: 540373 - RNA, 32 nt, Human
uugcucuuguugcccaggcuggagggcaaugg

SEQ ID NO: 540374 - RNA, 32 nt, Human
uugcucuuguugcccaggcuggaguacaaugg

SEQ ID NO: 540375 - RNA, 32 nt, Human
uugcucuuguugcccaggcuggagugcaauag

SEQ ID NO: 540376 - RNA, 32 nt, Human
uugcucuuguugcccaggcuggagugcaauga

SEQ ID NO: 540377 - RNA, 32 nt, Human
uugcucuuguugcccaggcuggagugcaaugg

SEQ ID NO: 540378 - RNA, 32 nt, Human
uugcucuuguugcccaggcuggagugcaguga

SEQ ID NO: 540379 - RNA, 32 nt, Human
uugcucuuguugcccaggcuggagugcagugg

SEQ ID NO: 540380 - RNA, 32 nt, Human
uugcucuuguugcccaggcuggagugugaugg

SEQ ID NO: 540381 - RNA, 32 nt, Human
uugcucuuguuucccaggcuggagugcaaugg

SEQ ID NO: 540382 - RNA, 32 nt, Human
uugcucuuuccuucucuccaucauagucuggg

SEQ ID NO: 540383 - RNA, 32 nt, Human
uugcucuuuugcucccaaccaggaagccauca

SEQ ID NO: 540384 - RNA, 32 nt, Human
uugcucuuuuuccuccccuccuccuccucucc

SEQ ID NO: 540385 - RNA, 32 nt, Human
uugcugaaaauacaaaauuagccaggcguggu

SEQ ID NO: 540386 - RNA, 32 nt, Human
uugcugaaacuagauguuuuuacaugagaaau

SEQ ID NO: 540387 - RNA, 31 nt, Human
uugcugaagagagagacaaaagacugccaaa

SEQ ID NO: 540388 - RNA, 32 nt, Human
uugcugaauuccagaguccuuuuggaaaacug

SEQ ID NO: 540389 - RNA, 31 nt, Human
uugcugaauucgauaggauguugaaaugcug

SEQ ID NO: 540390 - RNA, 32 nt, Human
uugcugacagcaggugcauuccugcuucccuc

SEQ ID NO: 540391 - RNA, 32 nt, Human
uugcugacagcugccaagaaaaugcuucacuc

SEQ ID NO: 540392 - RNA, 32 nt, Human
uugcugacaggaggaggaaguaguggagauca

SEQ ID NO: 540393 - RNA, 32 nt, Human
uugcugacauggaggcaagucccacugcucuc

SEQ ID NO: 540394 - RNA, 32 nt, Human
uugcugaccacaggccuggccuggagaaaccc

SEQ ID NO: 540395 - RNA, 32 nt, Human
uugcugaccagccuggccggcuggcggagaaa

SEQ ID NO: 540396 - RNA, 32 nt, Human
uugcugaccgccgacugucaauggagcuggaa

SEQ ID NO: 540397 - RNA, 32 nt, Human
uugcugacguguuaaucuuuucaucugugagu

SEQ ID NO: 540398 - RNA, 32 nt, Human
uugcugacugacccuccaccucagagguaguu

SEQ ID NO: 540399 - RNA, 32 nt, Human
uugcugacuggcuucucccuuucuuacucaca

SEQ ID NO: 540400 - RNA, 32 nt, Human
uugcugagaaggcugugcuggcggcuaauggg

SEQ ID NO: 540401 - RNA, 20 nt, Human
uugcugagaauucuaugguc

SEQ ID NO: 540402 - RNA, 32 nt, Human
uugcugagagccaaacagagcccagggagacu

SEQ ID NO: 540403 - RNA, 15 nt, Human
uugcugagcaaggug

SEQ ID NO: 540404 - RNA, 32 nt, Human
uugcugaggaccaaggaggagaagagaccuuu

SEQ ID NO: 540405 - RNA, 21 nt, Human
uugcugaggcuggagugcagu

SEQ ID NO: 540406 - RNA, 32 nt, Human
uugcugaggcuggagugcagugaugugaucuu

SEQ ID NO: 540407 - RNA, 32 nt, Human
uugcugagggcagagggagacccagggcuacc

SEQ ID NO: 540408 - RNA, 32 nt, Human
uugcugagggccuaguuuccauggcuccgaag

SEQ ID NO: 540409 - RNA, 20 nt, Human
uugcugaggguuacuguauc

SEQ ID NO: 540410 - RNA, 32 nt, Human
uugcugaguacccagaguugcgaggaguuuuu

SEQ ID NO: 540411 - RNA, 32 nt, Human
uugcugagucaagaguguaaauaaaagaaaug

SEQ ID NO: 540412 - RNA, 32 nt, Human
uugcugagucccuggcacccagcaucagcccc

SEQ ID NO: 540413 - RNA, 18 nt, Human
uugcugagucucagccuu

SEQ ID NO: 540414 - RNA, 32 nt, Human
uugcugaguggaugacaaaaagaggggaauug

SEQ ID NO: 540415 - RNA, 32 nt, Human
uugcugaguuagcaguggugguaagcgugugu

SEQ ID NO: 540416 - RNA, 32 nt, Human
uugcugaucgccugggugguuguuggcguguc

SEQ ID NO: 540417 - RNA, 32 nt, Human
uugcugaugauggccuuaaagguggugaggga

SEQ ID NO: 540418 - RNA, 32 nt, Human
uugcugaugguauggcuguggucugggacuug

SEQ ID NO: 540419 - RNA, 32 nt, Human
uugcugauuagaacauagcucucuccaggaag

SEQ ID NO: 540420 - RNA, 32 nt, Human
uugcugcaaaaugacccagaggcaggggucag

SEQ ID NO: 540421 - RNA, 32 nt, Human
uugcugcaaucagugguccauuguuuccagug

SEQ ID NO: 540422 - RNA, 32 nt, Human
uugcugcaauuuucguggaauucauguugcuc

SEQ ID NO: 540423 - RNA, 32 nt, Human
uugcugcagacacccuugcuccugagucauua

SEQ ID NO: 540424 - RNA, 32 nt, Human
uugcugcagaggauccaguccagaucccagga

SEQ ID NO: 540425 - RNA, 32 nt, Human
uugcugcaggagguggguauuguguguguggg

SEQ ID NO: 540426 - RNA, 32 nt, Human
uugcugcaggcucuggggagucgccaugccua

SEQ ID NO: 540427 - RNA, 32 nt, Human
uugcugcagggaagaggagagcccccugcccu

SEQ ID NO: 540428 - RNA, 32 nt, Human
uugcugcaggggcagggcacucauggagaacc

SEQ ID NO: 540429 - RNA, 31 nt, Human
uugcugcaguuuccaccacucuuauacagga

SEQ ID NO: 540430 - RNA, 32 nt, Human
uugcugcauagaaggggcagguguugguuuuu

SEQ ID NO: 540431 - RNA, 32 nt, Human
uugcugcauucugccucucuaggaccaugguu

SEQ ID NO: 540432 - RNA, 20 nt, Human
uugcugcauugcccgggcua

SEQ ID NO: 540433 - RNA, 32 nt, Human
uugcugccaagugcgaauaaacggcgugauug

SEQ ID NO: 540434 - RNA, 32 nt, Human
uugcugccaauacagcugucauggcguccaag

SEQ ID NO: 540435 - RNA, 20 nt, Human
uugcugccacaccugagcca

SEQ ID NO: 540436 - RNA, 32 nt, Human
uugcugccaccaacauggagacuuuguaccgu

SEQ ID NO: 540437 - RNA, 32 nt, Human
uugcugccacgaggugguccaagccuucaggg

SEQ ID NO: 540438 - RNA, 32 nt, Human
uugcugccagcagggcccuuguuugggauuau

SEQ ID NO: 540439 - RNA, 32 nt, Human
uugcugccagccagggauguccagaggucggu

SEQ ID NO: 540440 - RNA, 23 nt, Human
uugcugccagggacccugagcca

SEQ ID NO: 540441 - RNA, 32 nt, Human
uugcugccauuggcaugaaauggccaacugug

SEQ ID NO: 540442 - RNA, 32 nt, Human
uugcugcccacauugugccuuuauuuuaugag

SEQ ID NO: 540443 - RNA, 22 nt, Human
uugcugcccaggcuagagugca

SEQ ID NO: 540444 - RNA, 24 nt, Human
uugcugcccaggcuagagugcaau

SEQ ID NO: 540445 - RNA, 32 nt, Human
uugcugcccaggcuagagugcaauggugcgau

SEQ ID NO: 540446 - RNA, 32 nt, Human
uugcugcccaggcucuagaucacauggcauca

SEQ ID NO: 540447 - RNA, 22 nt, Human
uugcugcccaggcuggagugca

SEQ ID NO: 540448 - RNA, 24 nt, Human
uugcugcccaggcuggagugcaau

SEQ ID NO: 540449 - RNA, 32 nt, Human
uugcugcccaggcuggagugcaauggugcaau

SEQ ID NO: 540450 - RNA, 24 nt, Human
uugcugcccaggcuggagugcagu

SEQ ID NO: 540451 - RNA, 32 nt, Human
uugcugcccaggcuggagugcaguggcucaau

SEQ ID NO: 540452 - RNA, 32 nt, Human
uugcugccccagcugcuggcgugcugucagca

SEQ ID NO: 540453 - RNA, 20 nt, Human
uugcugccccgccugggcca

SEQ ID NO: 540454 - RNA, 32 nt, Human
uugcugccccucuccccuaccuggcccauuca

SEQ ID NO: 540455 - RNA, 32 nt, Human
uugcugcccgucugcugaugugaccaguggca

SEQ ID NO: 540456 - RNA, 32 nt, Human
uugcugcccugccugucacguggcccugccua

SEQ ID NO: 540457 - RNA, 32 nt, Human
uugcugccgccgccaccgccccggcugccauc

SEQ ID NO: 540458 - RNA, 32 nt, Human
uugcugccuccuccuccuccaccugcucuccu

SEQ ID NO: 540459 - RNA, 32 nt, Human
uugcugccuccuccuccuccugcagcagcacc

SEQ ID NO: 540460 - RNA, 32 nt, Human
uugcugccucuaucuggucugccuugcccguu

SEQ ID NO: 540461 - RNA, 32 nt, Human
uugcugccucucaucaccucugccucaagaca

SEQ ID NO: 540462 - RNA, 32 nt, Human
uugcugccugagaggaaccagagcagacgcac

SEQ ID NO: 540463 - RNA, 32 nt, Human
uugcugccuggggccugcucucucccaggaau

SEQ ID NO: 540464 - RNA, 32 nt, Human
uugcugcgcacaccuguacucuccaaugaaca

SEQ ID NO: 540465 - RNA, 32 nt, Human
uugcugcgcuugcauccaugcccagccaauau

SEQ ID NO: 540466 - RNA, 32 nt, Human
uugcugcggaugcacagggaaagaucauguuu

SEQ ID NO: 540467 - RNA, 32 nt, Human
uugcugcggccucgaccuccugggcuuaagcg

SEQ ID NO: 540468 - RNA, 20 nt, Human
uugcugcuaauguccagcua

SEQ ID NO: 540469 - RNA, 32 nt, Human
uugcugcuauccuuguuauccuucccacuguu

SEQ ID NO: 540470 - RNA, 18 nt, Human
uugcugcucagcagacca

SEQ ID NO: 540471 - RNA, 32 nt, Human
uugcugcucaucuuggacagggaacacagguu

SEQ ID NO: 540472 - RNA, 19 nt, Human
uugcugcuccuuuggggca

SEQ ID NO: 540473 - RNA, 20 nt, Human
uugcugcucguuccccgggc

SEQ ID NO: 540474 - RNA, 32 nt, Human
uugcugcucucagagccagaaaaugcugacag

SEQ ID NO: 540475 - RNA, 32 nt, Human
uugcugcugaaagaugucugugugcccguauc

SEQ ID NO: 540476 - RNA, 32 nt, Human
uugcugcugaaagaugucugugugccuguauc

SEQ ID NO: 540477 - RNA, 32 nt, Human
uugcugcugaaggaggaggcagcagcgagguc

SEQ ID NO: 540478 - RNA, 32 nt, Human
uugcugcugagaacaucucugccuaauuuacc

SEQ ID NO: 540479 - RNA, 32 nt, Human
uugcugcugauagaggugaaaacgagauugau

SEQ ID NO: 540480 - RNA, 32 nt, Human
uugcugcugcaguauugaaacugugaagaacu

SEQ ID NO: 540481 - RNA, 20 nt, Human
uugcugcugccuccugggcu

SEQ ID NO: 540482 - RNA, 32 nt, Human
uugcugcugccugguguguccucagcucccag

SEQ ID NO: 540483 - RNA, 32 nt, Human
uugcugcugcgggaguccagagaggcaggagg

SEQ ID NO: 540484 - RNA, 32 nt, Human
uugcugcugcugcacccaacuacugagcugag

SEQ ID NO: 540485 - RNA, 19 nt, Human
uugcugcugcuucuccaga

SEQ ID NO: 540486 - RNA, 32 nt, Human
uugcugcuguuuggugacuggaagaggcacca

SEQ ID NO: 540487 - RNA, 32 nt, Human
uugcugcuucucuccagcuccugaacuuuucu

SEQ ID NO: 540488 - RNA, 21 nt, Human
uugcugcuucuguucuggguc

SEQ ID NO: 540489 - RNA, 19 nt, Human
uugcugcuugaaccgguca

SEQ ID NO: 540490 - RNA, 21 nt, Human
uugcugcuugcuugguccaca

SEQ ID NO: 540491 - RNA, 17 nt, Human
uugcugcuugucccagc

SEQ ID NO: 540492 - RNA, 32 nt, Human
uugcuggaacaacaacugacuucaugauuugc

SEQ ID NO: 540493 - RNA, 19 nt, Human
uugcuggaaccaccaagga

SEQ ID NO: 540494 - RNA, 32 nt, Human
uugcuggaacccaggagguggagguugcagug

SEQ ID NO: 540495 - RNA, 32 nt, Human
uugcuggaagaugaagugacugugcguguaag

SEQ ID NO: 540496 - RNA, 32 nt, Human
uugcuggaagcagccacaguuuggaaggggca

SEQ ID NO: 540497 - RNA, 32 nt, Human
uugcuggaauagggaucaagaggaauauaaaa

SEQ ID NO: 540498 - RNA, 32 nt, Human
uugcuggaaugaguuaagauuugggggacugu

SEQ ID NO: 540499 - RNA, 32 nt, Human
uugcuggacaacagacauaugccaccaauugu

SEQ ID NO: 540500 - RNA, 32 nt, Human
uugcuggacacaucucuuugcagguagcagca

SEQ ID NO: 540501 - RNA, 32 nt, Human
uugcuggagcccaggaggcacaggcugcagug

SEQ ID NO: 540502 - RNA, 32 nt, Human
uugcuggaggccaagcaagaaaagucaaugua

SEQ ID NO: 540503 - RNA, 32 nt, Human
uugcuggaucugcucccucucgcucucucacu

SEQ ID NO: 540504 - RNA, 32 nt, Human
uugcuggcaguggacauuauucuugcccuaag

SEQ ID NO: 540505 - RNA, 32 nt, Human
uugcuggcaguggagggcuugccaugaaaaug

SEQ ID NO: 540506 - RNA, 32 nt, Human
uugcuggcaucccggccaggugggcggggauu

SEQ ID NO: 540507 - RNA, 32 nt, Human
uugcuggccagcacuuguguagaaagaucgcu

SEQ ID NO: 540508 - RNA, 32 nt, Human
uugcuggccagcuugcccuucagcuaaugagu

SEQ ID NO: 540509 - RNA, 32 nt, Human
uugcuggccagggaguuggggacucagaggga

SEQ ID NO: 540510 - RNA, 32 nt, Human
uugcuggccauucuuggcuuuuagaagggaaa

SEQ ID NO: 540511 - RNA, 32 nt, Human
uugcuggccuggaagggaggagcgcccucuag

SEQ ID NO: 540512 - RNA, 32 nt, Human
uugcuggcuaauugacaguauuucucagcauc

SEQ ID NO: 540513 - RNA, 21 nt, Human
uugcuggcucguccccagcca

SEQ ID NO: 540514 - RNA, 32 nt, Human
uugcuggcugggccacgcgugcuugagaaggu

SEQ ID NO: 540515 - RNA, 23 nt, Human
uugcuggcugugaaaccaggaca

SEQ ID NO: 540516 - RNA, 32 nt, Human
uugcuggcuuaggacagagcaauacuuuacaa

SEQ ID NO: 540517 - RNA, 32 nt, Human
uugcuggcuucaggaguggagugagaauuucu

SEQ ID NO: 540518 - RNA, 24 nt, Human
uugcuggcuugugacucugggcca

SEQ ID NO: 540519 - RNA, 32 nt, Human
uugcugggaagagaggcgaagccaggucaccu

SEQ ID NO: 540520 - RNA, 32 nt, Human
uugcugggaauggaguugggaggcagguguug

SEQ ID NO: 540521 - RNA, 32 nt, Human
uugcugggaccuguuccacaaaugggcgucuu

SEQ ID NO: 540522 - RNA, 32 nt, Human
uugcugggacucggccggcucacaugcuauuc

SEQ ID NO: 540523 - RNA, 32 nt, Human
uugcugggaucauggcggagaaucacugcgag

SEQ ID NO: 540524 - RNA, 32 nt, Human
uugcugggaucauggcggggaaucacugcgag

SEQ ID NO: 540525 - RNA, 32 nt, Human
uugcugggauuuacaggcaugagccaccgcac

SEQ ID NO: 540526 - RNA, 24 nt, Human
uugcugggcacguggcagcauggg

SEQ ID NO: 540527 - RNA, 32 nt, Human
uugcugggcccagguguucaagguuauaguga

SEQ ID NO: 540528 - RNA, 32 nt, Human
uugcugggccuuggugugagagcaggcauauu

SEQ ID NO: 540529 - RNA, 17 nt, Human
uugcuggggaagggccc

SEQ ID NO: 540530 - RNA, 21 nt, Human
uugcuggggagguaaccguga

SEQ ID NO: 540531 - RNA, 32 nt, Human
uugcuggggccccuccugccuccacgcccacc

SEQ ID NO: 540532 - RNA, 32 nt, Human
uugcuggggccucuggacacaggcuggaccag

SEQ ID NO: 540533 - RNA, 32 nt, Human
uugcuggggguccuugagaaagcugcuucccc

SEQ ID NO: 540534 - RNA, 32 nt, Human
uugcuggguccucauguggcagagagagcaac

SEQ ID NO: 540535 - RNA, 32 nt, Human
uugcuggguggguaugggggagggggagacuc

SEQ ID NO: 540536 - RNA, 20 nt, Human
uugcuggguguauuauuuca

SEQ ID NO: 540537 - RNA, 23 nt, Human
uugcugguacaaagaccaaaaca

SEQ ID NO: 540538 - RNA, 20 nt, Human
uugcugguauucuagcucuu

SEQ ID NO: 540539 - RNA, 32 nt, Human
uugcuggucacugcaaccucugccuccugggu

SEQ ID NO: 540540 - RNA, 32 nt, Human
uugcugguccaagugcaauauguaauuauaaa

SEQ ID NO: 540541 - RNA, 32 nt, Human
uugcugguccuggcuauuuuugugucauuuau

SEQ ID NO: 540542 - RNA, 32 nt, Human
uugcuggucucaaacuccugaccucgggugau

SEQ ID NO: 540543 - RNA, 32 nt, Human
uugcuggucuggugucuuauuuccuaaaguga

SEQ ID NO: 540544 - RNA, 32 nt, Human
uugcuggugaacagccuguuugcuggaaugga

SEQ ID NO: 540545 - RNA, 32 nt, Human
uugcuggugggaaugugaaauggugcagccac

SEQ ID NO: 540546 - RNA, 32 nt, Human
uugcugguugagauggauucucgcucuguagc

SEQ ID NO: 540547 - RNA, 32 nt, Human
uugcuguacaacacuggcugugucucaaagcg

SEQ ID NO: 540548 - RNA, 32 nt, Human
uugcuguacagauccagagagccuuuuguccc

SEQ ID NO: 540549 - RNA, 32 nt, Human
uugcuguagcugggcggggagcagcucagcuc

SEQ ID NO: 540550 - RNA, 22 nt, Human
uugcugucaauguuuugaguca

SEQ ID NO: 540551 - RNA, 32 nt, Human
uugcugucauuuucugucucggcucccuccuc

SEQ ID NO: 540552 - RNA, 32 nt, Human
uugcuguccacucauaucagcuguguaguagc

SEQ ID NO: 540553 - RNA, 20 nt, Human
uugcuguccuuuuccaagga

SEQ ID NO: 540554 - RNA, 32 nt, Human
uugcugucuccccggcuggagcgcaguggcac

SEQ ID NO: 540555 - RNA, 32 nt, Human
uugcugucucugcucgcccuccuuucugugcc

SEQ ID NO: 540556 - RNA, 32 nt, Human
uugcugucugccuuugaaacuauauuuagaaa

SEQ ID NO: 540557 - RNA, 32 nt, Human
uugcugucuggcuuccucagacuuaaagcagc

SEQ ID NO: 540558 - RNA, 32 nt, Human
uugcugucugucuccaccccagccucuguucc

SEQ ID NO: 540559 - RNA, 32 nt, Human
uugcugucuuucuccuccagagggucuguguc

SEQ ID NO: 540560 - RNA, 32 nt, Human
uugcugugaacaaacuggacaggcuccgcggg

SEQ ID NO: 540561 - RNA, 32 nt, Human
uugcugugaacugcaguguuucauacgaacca

SEQ ID NO: 540562 - RNA, 23 nt, Human
uugcugugaucauaacugugauc

SEQ ID NO: 540563 - RNA, 32 nt, Human
uugcugugcacccagagauaguugggugacaa

SEQ ID NO: 540564 - RNA, 32 nt, Human
uugcugugcaggucgucaggaucugggcuucu

SEQ ID NO: 540565 - RNA, 32 nt, Human
uugcugugcccgugcagcuggcaccaacagaa

SEQ ID NO: 540566 - RNA, 32 nt, Human
uugcugugcccuguggccuggccgcagugagg

SEQ ID NO: 540567 - RNA, 32 nt, Human
uugcugugccuagucuagugucccccaaagca

SEQ ID NO: 540568 - RNA, 32 nt, Human
uugcugugccuccuauguaugucugguuugcu

SEQ ID NO: 540569 - RNA, 32 nt, Human
uugcugugcugaagcuuuguuuaaugaaaucc

SEQ ID NO: 540570 - RNA, 32 nt, Human
uugcuguggaagucaccaggccuccccuccug

SEQ ID NO: 540571 - RNA, 20 nt, Human
uugcugugggcacaccccag

SEQ ID NO: 540572 - RNA, 32 nt, Human
uugcuguggggguucagggagguggagauggg

SEQ ID NO: 540573 - RNA, 32 nt, Human
uugcugugucaccaggauggagugcaguggca

SEQ ID NO: 540574 - RNA, 32 nt, Human
uugcuguguccaacuccaguaccuggagcuuc

SEQ ID NO: 540575 - RNA, 32 nt, Human
uugcugugucugcaggcucacacgggaacucu

SEQ ID NO: 540576 - RNA, 32 nt, Human
uugcugugugcaucccagaggaggcacgucug

SEQ ID NO: 540577 - RNA, 22 nt, Human
uugcugugugcuagacuuucca

SEQ ID NO: 540578 - RNA, 32 nt, Human
uugcuguguggaagcagcgggggaagaccuag

SEQ ID NO: 540579 - RNA, 32 nt, Human
uugcuguguugcccaggaugguuucaaacucc

SEQ ID NO: 540580 - RNA, 21 nt, Human
uugcuguguugcucugagcua

SEQ ID NO: 540581 - RNA, 32 nt, Human
uugcuguuaccugguauuuccacucucacagu

SEQ ID NO: 540582 - RNA, 32 nt, Human
uugcuguuagaggcucuuucccagaaguugga

SEQ ID NO: 540583 - RNA, 32 nt, Human
uugcuguuagucuaaccuguaccauuuuguaa

SEQ ID NO: 540584 - RNA, 32 nt, Human
uugcuguucagugcuuuuuccuuuucaucugu

SEQ ID NO: 540585 - RNA, 32 nt, Human
uugcuguucccucagcucccagcuccaccucu

SEQ ID NO: 540586 - RNA, 32 nt, Human
uugcuguucuccaaggaaguucguuuccucug

SEQ ID NO: 540587 - RNA, 32 nt, Human
uugcuguucucucccuuucuucaugcccuguu

SEQ ID NO: 540588 - RNA, 32 nt, Human
uugcuguucugaguacugcucucaucacaccc

SEQ ID NO: 540589 - RNA, 32 nt, Human
uugcuguucugugugugccugcccugggggug

SEQ ID NO: 540590 - RNA, 32 nt, Human
uugcuguuggcugggcuacuguauacagugua

SEQ ID NO: 540591 - RNA, 32 nt, Human
uugcuguugggaggaagcagaggcagauggga

SEQ ID NO: 540592 - RNA, 32 nt, Human
uugcuguugggaggagucgggggcgagccuua

SEQ ID NO: 540593 - RNA, 32 nt, Human
uugcuguuuauaacagaaaacagacuuguaaa

SEQ ID NO: 540594 - RNA, 20 nt, Human
uugcuguuucuagugggcca

SEQ ID NO: 540595 - RNA, 32 nt, Human
uugcuguuucuccuugagaugcuuuuggagug

SEQ ID NO: 540596 - RNA, 18 nt, Human
uugcuguuucuguagcca

SEQ ID NO: 540597 - RNA, 32 nt, Human
uugcuguuucuucugcagucuuugcacugagg

SEQ ID NO: 540598 - RNA, 18 nt, Human
uugcuguuugaggagcca

SEQ ID NO: 540599 - RNA, 32 nt, Human
uugcuguuugcaauuuuuccaugaaguuugaa

SEQ ID NO: 540600 - RNA, 32 nt, Human
uugcuuaaauguuugcagucagugcaagacaa

SEQ ID NO: 540601 - RNA, 32 nt, Human
uugcuuaaccauuccucuaccucuugcauuuu

SEQ ID NO: 540602 - RNA, 32 nt, Human
uugcuuaagucugggagguugaggcugcagug

SEQ ID NO: 540603 - RNA, 32 nt, Human
uugcuuaauguccuccauuuacacuucucagc

SEQ ID NO: 540604 - RNA, 32 nt, Human
uugcuuacacccagagugcacacucacaggaa

SEQ ID NO: 540605 - RNA, 32 nt, Human
uugcuuacaccuguaaucccagcacuuuggga

SEQ ID NO: 540606 - RNA, 32 nt, Human
uugcuuacuuuuuaccaggagugcaguucauu

SEQ ID NO: 540607 - RNA, 32 nt, Human
uugcuuagaagccaucuaaucucagguuuaua

SEQ ID NO: 540608 - RNA, 32 nt, Human
uugcuuaggaggaggaaggggaaaguauacuu

SEQ ID NO: 540609 - RNA, 32 nt, Human
uugcuuaggccaccauugucugccucaucagg

SEQ ID NO: 540610 - RNA, 32 nt, Human
uugcuuaguugaagagaauaaagggaauaaga

SEQ ID NO: 540611 - RNA, 32 nt, Human
uugcuucaaagaugcccaacccccguaguagc

SEQ ID NO: 540612 - RNA, 32 nt, Human
uugcuucaacacagcaagcccaaugcacccag

SEQ ID NO: 540613 - RNA, 32 nt, Human
uugcuucacaguuaacagaaucuucacagaca

SEQ ID NO: 540614 - RNA, 32 nt, Human
uugcuucaccaggucugcucaggucagcgggg

SEQ ID NO: 540615 - RNA, 32 nt, Human
uugcuucacugcaauuuguuucugaucuccag

SEQ ID NO: 540616 - RNA, 32 nt, Human
uugcuucagcccuucccugagugcaguccccc

SEQ ID NO: 540617 - RNA, 32 nt, Human
uugcuucaggccgacuuccuaaggaaggcaug

SEQ ID NO: 540618 - RNA, 22 nt, Human
uugcuucagucuuugccuuugu

SEQ ID NO: 540619 - RNA, 32 nt, Human
uugcuucaucuucuggcuguuguggcacugac

SEQ ID NO: 540620 - RNA, 32 nt, Human
uugcuuccagaguucaagcuauucuccugucu

SEQ ID NO: 540621 - RNA, 32 nt, Human
uugcuucccacacaccucuccacgcucccagu

SEQ ID NO: 540622 - RNA, 21 nt, Human
uugcuucccacccauuccuca

SEQ ID NO: 540623 - RNA, 32 nt, Human
uugcuucccacccauuccucaucccucacucc

SEQ ID NO: 540624 - RNA, 32 nt, Human
uugcuucccaggagacugggcugggaacagga

SEQ ID NO: 540625 - RNA, 32 nt, Human
uugcuucccaggcuggagugcaguggugcgau

SEQ ID NO: 540626 - RNA, 32 nt, Human
uugcuucccgcagagugcagagacaggaagcu

SEQ ID NO: 540627 - RNA, 32 nt, Human
uugcuucccuaucuuggcuacugugaauaaug

SEQ ID NO: 540628 - RNA, 32 nt, Human
uugcuucccugagggcccccgcuggccaaggc

SEQ ID NO: 540629 - RNA, 32 nt, Human
uugcuucccuuucagcuuucuuccaucccugc

SEQ ID NO: 540630 - RNA, 32 nt, Human
uugcuucccuuuccagucacccuuggugcccu

SEQ ID NO: 540631 - RNA, 32 nt, Human
uugcuucccuuuccuuuguauuuucauuuuuc

SEQ ID NO: 540632 - RNA, 32 nt, Human
uugcuuccuaagaaaaugggugagugaaaaac

SEQ ID NO: 540633 - RNA, 32 nt, Human
uugcuuccuagcuuauuuauuucccaaacaac

SEQ ID NO: 540634 - RNA, 32 nt, Human
uugcuuccuaggauggauggcagauggcaaug

SEQ ID NO: 540635 - RNA, 32 nt, Human
uugcuuccucaccccugcucugaucuggaagg

SEQ ID NO: 540636 - RNA, 32 nt, Human
uugcuuccuccaccagucugaccucaguccuc

SEQ ID NO: 540637 - RNA, 32 nt, Human
uugcuuccuccaggacuugggacccuggagga

SEQ ID NO: 540638 - RNA, 32 nt, Human
uugcuuccucccugccuggccuagccagggcu

SEQ ID NO: 540639 - RNA, 32 nt, Human
uugcuuccugcucuccugugcggcgucugauu

SEQ ID NO: 540640 - RNA, 32 nt, Human
uugcuuccuggcucccugugcauuuuugucuu

SEQ ID NO: 540641 - RNA, 32 nt, Human
uugcuuccugugauacaacuugccaaaugcuu

SEQ ID NO: 540642 - RNA, 32 nt, Human
uugcuuccuuccuuccucucuuucuguuucuc

SEQ ID NO: 540643 - RNA, 32 nt, Human
uugcuucuacagcccguggacuuuagccuaaa

SEQ ID NO: 540644 - RNA, 21 nt, Human
uugcuucuaguccauccuucc

SEQ ID NO: 540645 - RNA, 32 nt, Human
uugcuucuaucgacagguaggugggugaaugg

SEQ ID NO: 540646 - RNA, 32 nt, Human
uugcuucuauggguaaggagugaggcacuuug

SEQ ID NO: 540647 - RNA, 24 nt, Human
uugcuucucaacaggugccuaccu

SEQ ID NO: 540648 - RNA, 32 nt, Human
uugcuucucaggggaggaagaaggaaugggca

SEQ ID NO: 540649 - RNA, 22 nt, Human
uugcuucucagugcucucuuuc

SEQ ID NO: 540650 - RNA, 32 nt, Human
uugcuucuccaaugcucaagugagucacaucu

SEQ ID NO: 540651 - RNA, 22 nt, Human
uugcuucucccuagugcuggua

SEQ ID NO: 540652 - RNA, 31 nt, Human
uugcuucuccucucugcuggcugagucugug

SEQ ID NO: 540653 - RNA, 21 nt, Human
uugcuucuccuucuccuuccu

SEQ ID NO: 540654 - RNA, 22 nt, Human
uugcuucucgcccaccucuucc

SEQ ID NO: 540655 - RNA, 21 nt, Human
uugcuucucucuccuucuuuc

SEQ ID NO: 540656 - RNA, 32 nt, Human
uugcuucucugaguaguuuccucugcugacau

SEQ ID NO: 540657 - RNA, 23 nt, Human
uugcuucugagaacagcagggug

SEQ ID NO: 540658 - RNA, 32 nt, Human
uugcuucugccuggcaucugugagcagcugcc

SEQ ID NO: 540659 - RNA, 22 nt, Human
uugcuucuggcugggugcggug

SEQ ID NO: 540660 - RNA, 24 nt, Human
uugcuucuggggaaauggcaggug

SEQ ID NO: 540661 - RNA, 32 nt, Human
uugcuucugguuucacacuuuuuaaccccucu

SEQ ID NO: 540662 - RNA, 32 nt, Human
uugcuucuguggcccaggcuggagugcagugg

SEQ ID NO: 540663 - RNA, 32 nt, Human
uugcuucuguucagucuccaucauggcaugcc

SEQ ID NO: 540664 - RNA, 32 nt, Human
uugcuucuguuguccacugauuaaucagccua

SEQ ID NO: 540665 - RNA, 22 nt, Human
uugcuucuuacccucccucccu

SEQ ID NO: 540666 - RNA, 32 nt, Human
uugcuucuuguucaaaggccucagccacccag

SEQ ID NO: 540667 - RNA, 32 nt, Human
uugcuucuuuuuccucuucccuucccacucuu

SEQ ID NO: 540668 - RNA, 32 nt, Human
uugcuugaaacccagaaggcagggguugcagu

SEQ ID NO: 540669 - RNA, 32 nt, Human
uugcuugaacagcuucuccugaguccuccuua

SEQ ID NO: 540670 - RNA, 32 nt, Human
uugcuugaacccaagaggcggagguuguggug

SEQ ID NO: 540671 - RNA, 32 nt, Human
uugcuugaacccaagaggucgaggcugcagug

SEQ ID NO: 540672 - RNA, 32 nt, Human
uugcuugaacccagaagguagagguugcagcc

SEQ ID NO: 540673 - RNA, 32 nt, Human
uugcuugaacccaggaagcggagguugcagug

SEQ ID NO: 540674 - RNA, 32 nt, Human
uugcuugaacccaggaagcggagguuguggug

SEQ ID NO: 540675 - RNA, 32 nt, Human
uugcuugaacccaggaaguggcaguugcagug

SEQ ID NO: 540676 - RNA, 32 nt, Human
uugcuugaacccaggagacauggguugcagug

SEQ ID NO: 540677 - RNA, 32 nt, Human
uugcuugaacccaggagacggagguugcagug

SEQ ID NO: 540678 - RNA, 32 nt, Human
uugcuugaacccaggagauagagguugcaaug

SEQ ID NO: 540679 - RNA, 32 nt, Human
uugcuugaacccaggagauggaaguugcagug

SEQ ID NO: 540680 - RNA, 32 nt, Human
uugcuugaacccaggagauggagguugcagug

SEQ ID NO: 540681 - RNA, 32 nt, Human
uugcuugaacccaggagauggagguugcggug

SEQ ID NO: 540682 - RNA, 32 nt, Human
uugcuugaacccaggaggaagagguugcagug

SEQ ID NO: 540683 - RNA, 32 nt, Human
uugcuugaacccaggaggcagaggguugcagu

SEQ ID NO: 540684 - RNA, 32 nt, Human
uugcuugaacccaggaggcagagguuacagua

SEQ ID NO: 540685 - RNA, 32 nt, Human
uugcuugaacccaggaggcagagguuacagug

SEQ ID NO: 540686 - RNA, 32 nt, Human
uugcuugaacccaggaggcagagguugcagug

SEQ ID NO: 540687 - RNA, 32 nt, Human
uugcuugaacccaggaggcagagguuguagug

SEQ ID NO: 540688 - RNA, 32 nt, Human
uugcuugaacccaggaggcgaagguugcagua

SEQ ID NO: 540689 - RNA, 32 nt, Human
uugcuugaacccaggaggcggagauugcagug

SEQ ID NO: 540690 - RNA, 32 nt, Human
uugcuugaacccaggaggcggaggcagaggcu

SEQ ID NO: 540691 - RNA, 32 nt, Human
uugcuugaacccaggaggcggagguagcagug

SEQ ID NO: 540692 - RNA, 32 nt, Human
uugcuugaacccaggaggcggagguaguggug

SEQ ID NO: 540693 - RNA, 32 nt, Human
uugcuugaacccaggaggcggagguugcacug

SEQ ID NO: 540694 - RNA, 32 nt, Human
uugcuugaacccaggaggcggagguugcagug

SEQ ID NO: 540695 - RNA, 32 nt, Human
uugcuugaacccaggaggcggagguugccgug

SEQ ID NO: 540696 - RNA, 32 nt, Human
uugcuugaacccaggaggcggagguugcggug

SEQ ID NO: 540697 - RNA, 32 nt, Human
uugcuugaacccaggaggcggagguuguagug

SEQ ID NO: 540698 - RNA, 32 nt, Human
uugcuugaacccaggaggcggaguuugcagug

SEQ ID NO: 540699 - RNA, 32 nt, Human
uugcuugaacccaggaggcggggguugcagug

SEQ ID NO: 540700 - RNA, 32 nt, Human
uugcuugaacccaggaggcugagguugcagug

SEQ ID NO: 540701 - RNA, 32 nt, Human
uugcuugaacccaggagguagaaguugcagug

SEQ ID NO: 540702 - RNA, 32 nt, Human
uugcuugaacccaggagguggagguugcagua

SEQ ID NO: 540703 - RNA, 32 nt, Human
uugcuugaacccaggagguggagguugcagug

SEQ ID NO: 540704 - RNA, 32 nt, Human
uugcuugaacccaggagguggagguuguggug

SEQ ID NO: 540705 - RNA, 32 nt, Human
uugcuugaacccaggagguggaguuugcagug

SEQ ID NO: 540706 - RNA, 32 nt, Human
uugcuugaacccaggcaguggagguugcagug

SEQ ID NO: 540707 - RNA, 32 nt, Human
uugcuugaacccagggggcagagguugcagug

SEQ ID NO: 540708 - RNA, 32 nt, Human
uugcuugaacccaugaggcggagguugcagug

SEQ ID NO: 540709 - RNA, 32 nt, Human
uugcuugaacccaugagguggagguugcggug

SEQ ID NO: 540710 - RNA, 32 nt, Human
uugcuugaauccaggaggcagagguugcaaug

SEQ ID NO: 540711 - RNA, 32 nt, Human
uugcuugaauccaggaggcagagguugcagug

SEQ ID NO: 540712 - RNA, 32 nt, Human
uugcuugaauccaggaggcggagguugcagug

SEQ ID NO: 540713 - RNA, 32 nt, Human
uugcuugaauccaggagguggagguugcagcg

SEQ ID NO: 540714 - RNA, 32 nt, Human
uugcuugaccccaggagguggacauugcagug

SEQ ID NO: 540715 - RNA, 32 nt, Human
uugcuugacuucacuccagggugagacuugac

SEQ ID NO: 540716 - RNA, 32 nt, Human
uugcuugacuuuuuauaugauauugugcaaau

SEQ ID NO: 540717 - RNA, 32 nt, Human
uugcuugagaggcaguguggcuucugugacug

SEQ ID NO: 540718 - RNA, 32 nt, Human
uugcuugagcccaagagguugaggcugcagug

SEQ ID NO: 540719 - RNA, 32 nt, Human
uugcuugagcccagaaguugaagaccagccug

SEQ ID NO: 540720 - RNA, 32 nt, Human
uugcuugagcccaggagagugaggcuaggcau

SEQ ID NO: 540721 - RNA, 32 nt, Human
uugcuugagcccaggaggcagagguugcagua

SEQ ID NO: 540722 - RNA, 32 nt, Human
uugcuugagcccaggaggcagagguugcagug

SEQ ID NO: 540723 - RNA, 32 nt, Human
uugcuugagcccaggaggucaaggcugcagug

SEQ ID NO: 540724 - RNA, 32 nt, Human
uugcuugagcccaggaggucgaggcugcagug

SEQ ID NO: 540725 - RNA, 32 nt, Human
uugcuugagcccaggagguugaggcugcagug

SEQ ID NO: 540726 - RNA, 32 nt, Human
uugcuugagcccaggaguucaagaccagccug

SEQ ID NO: 540727 - RNA, 32 nt, Human
uugcuugagcccaggaguucaagagcagccug

SEQ ID NO: 540728 - RNA, 32 nt, Human
uugcuugagcccaggaguuggagaccagucug

SEQ ID NO: 540729 - RNA, 32 nt, Human
uugcuugagcccaggaguuuaagguuguagug

SEQ ID NO: 540730 - RNA, 32 nt, Human
uugcuugagcccaggaguuugagccuucagug

SEQ ID NO: 540731 - RNA, 32 nt, Human
uugcuugagcccaggaguuugagggcagccug

SEQ ID NO: 540732 - RNA, 32 nt, Human
uugcuugagcccaggaguuugagguugcagug

SEQ ID NO: 540733 - RNA, 32 nt, Human
uugcuugagcccaggaguuugagguuguaggg

SEQ ID NO: 540734 - RNA, 32 nt, Human
uugcuugagcccaggaguuugaguccagccug

SEQ ID NO: 540735 - RNA, 32 nt, Human
uugcuugagcccagggguuugagaccagcuug

SEQ ID NO: 540736 - RNA, 32 nt, Human
uugcuugagcucaggaauuugaugauguagua

SEQ ID NO: 540737 - RNA, 32 nt, Human
uugcuugaggccagagguucaagaccagccug

SEQ ID NO: 540738 - RNA, 32 nt, Human
uugcuugaguccaggagguugaggcugcaguc

SEQ ID NO: 540739 - RNA, 32 nt, Human
uugcuugaguccaugguugaugcugcugagaa

SEQ ID NO: 540740 - RNA, 32 nt, Human
uugcuugaugugugugcaauguacauacuuga

SEQ ID NO: 540741 - RNA, 32 nt, Human
uugcuugauugagcuuauuacucucuauuuug

SEQ ID NO: 540742 - RNA, 32 nt, Human
uugcuugcaaggaagcagugcguuauaucaau

SEQ ID NO: 540743 - RNA, 32 nt, Human
uugcuugcacacaccagcagagcuaagacugg

SEQ ID NO: 540744 - RNA, 32 nt, Human
uugcuugcacuccagccugggugacagaguga

SEQ ID NO: 540745 - RNA, 32 nt, Human
uugcuugcacuuccccuauugacacaugaaag

SEQ ID NO: 540746 - RNA, 31 nt, Human
uugcuugcacuuuuccacaucagaccuucca

SEQ ID NO: 540747 - RNA, 32 nt, Human
uugcuugccugugacaucucuguggcaggggu

SEQ ID NO: 540748 - RNA, 32 nt, Human
uugcuugcuauggagaaagauucugaacuuuc

SEQ ID NO: 540749 - RNA, 32 nt, Human
uugcuugcugaccuuuuucaaaacgaacugac

SEQ ID NO: 540750 - RNA, 32 nt, Human
uugcuugcugugugaauugacaagcacuuuua

SEQ ID NO: 540751 - RNA, 32 nt, Human
uugcuuggaccuaggagguggagguugcagug

SEQ ID NO: 540752 - RNA, 32 nt, Human
uugcuuggagcagcauuucauguucuuuugcu

SEQ ID NO: 540753 - RNA, 32 nt, Human
uugcuugggcacugucugugugcaggucaggc

SEQ ID NO: 540754 - RNA, 32 nt, Human
uugcuugggcccaggagauggagguugcggug

SEQ ID NO: 540755 - RNA, 32 nt, Human
uugcuuggguaacccagugcuugcuugcuuuc

SEQ ID NO: 540756 - RNA, 32 nt, Human
uugcuuggguuggacaauacaggaauugcuuc

SEQ ID NO: 540757 - RNA, 32 nt, Human
uugcuugguuauuccccucuugcucuucuuua

SEQ ID NO: 540758 - RNA, 32 nt, Human
uugcuuguacuguauguuucucuacuguaugg

SEQ ID NO: 540759 - RNA, 32 nt, Human
uugcuuguauacacaacagcuguuuugcuuuu

SEQ ID NO: 540760 - RNA, 32 nt, Human
uugcuuguauagccuuuugacccuucuugagu

SEQ ID NO: 540761 - RNA, 32 nt, Human
uugcuugucaaugucuuaaaacuacccuucac

SEQ ID NO: 540762 - RNA, 32 nt, Human
uugcuugucacccaggcuggagugcaauggca

SEQ ID NO: 540763 - RNA, 19 nt, Human
uugcuugugcccugggcca

SEQ ID NO: 540764 - RNA, 32 nt, Human
uugcuugugcucuccagaacccaacugccuca

SEQ ID NO: 540765 - RNA, 32 nt, Human
uugcuuguggagaagcgaagggcugaggggag

SEQ ID NO: 540766 - RNA, 20 nt, Human
uugcuuguuugucucaguua

SEQ ID NO: 540767 - RNA, 25 nt, Human
uugcuuuaaaagaagcaaugcagua

SEQ ID NO: 540768 - RNA, 32 nt, Human
uugcuuuaaagcucugucccuuacccacugac

SEQ ID NO: 540769 - RNA, 32 nt, Human
uugcuuuaauagaauaaugagagcaaguuugu

SEQ ID NO: 540770 - RNA, 32 nt, Human
uugcuuuacauacuagacauuuuucuucucuu

SEQ ID NO: 540771 - RNA, 32 nt, Human
uugcuuuaccugugcuggcuuccagagaugga

SEQ ID NO: 540772 - RNA, 32 nt, Human
uugcuuuacgaaacugcacuccugucuucugg

SEQ ID NO: 540773 - RNA, 22 nt, Human
uugcuuuacuuuucaccuugca

SEQ ID NO: 540774 - RNA, 32 nt, Human
uugcuuuagaacuaccaucuucauauacagga

SEQ ID NO: 540775 - RNA, 32 nt, Human
uugcuuuagaacuuauguggcaugacauagcu

SEQ ID NO: 540776 - RNA, 32 nt, Human
uugcuuuagccaaaggagagugcauggaggac

SEQ ID NO: 540777 - RNA, 32 nt, Human
uugcuuuaggcagagucagucacuuuucuucu

SEQ ID NO: 540778 - RNA, 32 nt, Human
uugcuuuaggcaggccccagagcucccugccu

SEQ ID NO: 540779 - RNA, 21 nt, Human
uugcuuuagucuuucauugca

SEQ ID NO: 540780 - RNA, 27 nt, Human
uugcuuuaguuuuuucaucuguuuugu

SEQ ID NO: 540781 - RNA, 32 nt, Human
uugcuuuauaagugaggguagggugagggagg

SEQ ID NO: 540782 - RNA, 32 nt, Human
uugcuuucaagcaaaaugccugggcuuggggg

SEQ ID NO: 540783 - RNA, 32 nt, Human
uugcuuucagaaguugacauuucuauucauug

SEQ ID NO: 540784 - RNA, 32 nt, Human
uugcuuucauacuacagcagcaauguugaaga

SEQ ID NO: 540785 - RNA, 32 nt, Human
uugcuuucaucacagccugaaaauucacugga

SEQ ID NO: 540786 - RNA, 32 nt, Human
uugcuuucauuuaguugagaaaagccagcaua

SEQ ID NO: 540787 - RNA, 32 nt, Human
uugcuuucauuugaauauuaaaagugaauuuu

SEQ ID NO: 540788 - RNA, 32 nt, Human
uugcuuuccagaaauacuaucuauauuaauuu

SEQ ID NO: 540789 - RNA, 32 nt, Human
uugcuuuccaggguaucuaugugugugcaugu

SEQ ID NO: 540790 - RNA, 32 nt, Human
uugcuuuccccuuccuccucccucucucccuu

SEQ ID NO: 540791 - RNA, 24 nt, Human
uugcuuuccugagaagaugcggug

SEQ ID NO: 540792 - RNA, 32 nt, Human
uugcuuuccuuaacugaauuucaucaaauuca

SEQ ID NO: 540793 - RNA, 32 nt, Human
uugcuuucgccuguaaucccaacacuuuggga

SEQ ID NO: 540794 - RNA, 21 nt, Human
uugcuuucuccguuucuuccu

SEQ ID NO: 540795 - RNA, 32 nt, Human
uugcuuucucucccucuccugcgugucucuga

SEQ ID NO: 540796 - RNA, 32 nt, Human
uugcuuucucucucaugccuccugaggcuguu

SEQ ID NO: 540797 - RNA, 32 nt, Human
uugcuuucuggacuuuuuccaucuagagccug

SEQ ID NO: 540798 - RNA, 32 nt, Human
uugcuuucugugucuugguuucugccugcugc

SEQ ID NO: 540799 - RNA, 32 nt, Human
uugcuuucuucccuuguucaacaucagagaau

SEQ ID NO: 540800 - RNA, 32 nt, Human
uugcuuucuugucuuuucagaagcaagccaga

SEQ ID NO: 540801 - RNA, 32 nt, Human
uugcuuugaacccgggaggcagagguugugag

SEQ ID NO: 540802 - RNA, 32 nt, Human
uugcuuugagcagaguuggagugccuucaucc

SEQ ID NO: 540803 - RNA, 32 nt, Human
uugcuuugauucaggccagcugguuuuuccug

SEQ ID NO: 540804 - RNA, 24 nt, Human
uugcuuuggcagucucucuucccc

SEQ ID NO: 540805 - RNA, 32 nt, Human
uugcuuuggcuucaucucuuuucugucagucu

SEQ ID NO: 540806 - RNA, 32 nt, Human
uugcuuugucaaucucugccccggucugaugu

SEQ ID NO: 540807 - RNA, 32 nt, Human
uugcuuuguguauacugaauuuuugcagcaaa

SEQ ID NO: 540808 - RNA, 32 nt, Human
uugcuuuguugccaggcuggagugcaguggcg

SEQ ID NO: 540809 - RNA, 32 nt, Human
uugcuuuuauuuccuccuccuucaccuccaac

SEQ ID NO: 540810 - RNA, 32 nt, Human
uugcuuuucacaucucuccuccuacagccuua

SEQ ID NO: 540811 - RNA, 32 nt, Human
uugcuuuucacgcccagggcucaguggcccag

SEQ ID NO: 540812 - RNA, 32 nt, Human
uugcuuuuccaguuaauguggccaugugauuc

SEQ ID NO: 540813 - RNA, 32 nt, Human
uugcuuuuccccucacuguuccugaaugcucu

SEQ ID NO: 540814 - RNA, 32 nt, Human
uugcuuuucuccccauaucccaaggcgaacgg

SEQ ID NO: 540815 - RNA, 32 nt, Human
uugcuuuucuuccucucucauuuggguuugag

SEQ ID NO: 540816 - RNA, 32 nt, Human
uugcuuuucuuuccucaucuucacugcccccu

SEQ ID NO: 540817 - RNA, 32 nt, Human
uugcuuuugaacacuuacuuaguucuuagcua

SEQ ID NO: 540818 - RNA, 24 nt, Human
uugcuuuugacuuuucaaugggug

SEQ ID NO: 540819 - RNA, 32 nt, Human
uugcuuuugcaucuucuguuccuggguaaugg

SEQ ID NO: 540820 - RNA, 32 nt, Human
uugcuuuugccucugcccaaccagguugcagu

SEQ ID NO: 540821 - RNA, 32 nt, Human
uugcuuuugggagacuggaaaagggaagguga

SEQ ID NO: 540822 - RNA, 22 nt, Human
uugcuuuugggagccagcggua

SEQ ID NO: 540823 - RNA, 32 nt, Human
uugcuuuuguguuauaaugaugcagcugcugc

SEQ ID NO: 540824 - RNA, 32 nt, Human
uugcuuuuucauuuucuuagcagugucucuca

SEQ ID NO: 540825 - RNA, 32 nt, Human
uugcuuuuugagacagagucucacucuguugc

SEQ ID NO: 540826 - RNA, 32 nt, Human
uuggaaaaacaaaaucugcaagcuuugaauga

SEQ ID NO: 540827 - RNA, 24 nt, Human
uuggaaaaaccuggugguguuuac

SEQ ID NO: 540828 - RNA, 32 nt, Human
uuggaaaaacuggccccauauuuuguguacac

SEQ ID NO: 540829 - RNA, 32 nt, Human
uuggaaaacagcccguuuacuuggcaagacug

SEQ ID NO: 540830 - RNA, 32 nt, Human
uuggaaaaccaaaaacaacuaacaagaaacca

SEQ ID NO: 540831 - RNA, 32 nt, Human
uuggaaaaccuuuugaacccucaaguuaccau

SEQ ID NO: 540832 - RNA, 32 nt, Human
uuggaaaacuaauguacagauuccacaacuca

SEQ ID NO: 540833 - RNA, 25 nt, Human
uuggaaaagacaguggagaugaggu

SEQ ID NO: 540834 - RNA, 32 nt, Human
uuggaaaagagacucauuugcugaugguucau

SEQ ID NO: 540835 - RNA, 32 nt, Human
uuggaaaagccagcuuacugccacucucuucc

SEQ ID NO: 540836 - RNA, 32 nt, Human
uuggaaaaguaauaggcgaaguagcuguaaag

SEQ ID NO: 540837 - RNA, 32 nt, Human
uuggaaaauacaacacaaaaagccaucuagcc

SEQ ID NO: 540838 - RNA, 32 nt, Human
uuggaaacagacaaguagaagaugcuacagaa

SEQ ID NO: 540839 - RNA, 32 nt, Human
uuggaaacguggugaugugcuguucguuuaua

SEQ ID NO: 540840 - RNA, 32 nt, Human
uuggaaacucuggggugaggccagccuucuag

SEQ ID NO: 540841 - RNA, 32 nt, Human
uuggaaacuugucugagacugacuuuaucaau

SEQ ID NO: 540842 - RNA, 32 nt, Human
uuggaaagaaaccagggggccaggggaacagg

SEQ ID NO: 540843 - RNA, 32 nt, Human
uuggaaagauagagcauucugucugggcagag

SEQ ID NO: 540844 - RNA, 32 nt, Human
uuggaaagcagccuggccaacauagugggacc

SEQ ID NO: 540845 - RNA, 32 nt, Human
uuggaaaggaaagcagcugagauccagaggag

SEQ ID NO: 540846 - RNA, 32 nt, Human
uuggaaaggagagucagguauuagaggaaaga

SEQ ID NO: 540847 - RNA, 32 nt, Human
uuggaaaggauuuaccguucugcaacaacgga

SEQ ID NO: 540848 - RNA, 32 nt, Human
uuggaaaggcagcagcaggacaaggaucagug

SEQ ID NO: 540849 - RNA, 32 nt, Human
uuggaaaggcugaguaggaauggugccuggca

SEQ ID NO: 540850 - RNA, 32 nt, Human
uuggaaaguucugcaauaagauucuaguucuc

SEQ ID NO: 540851 - RNA, 32 nt, Human
uuggaaaguuugcccgagggcuggugcaggcu

SEQ ID NO: 540852 - RNA, 32 nt, Human
uuggaaaguuuugaagucaggaaaagacguuu

SEQ ID NO: 540853 - RNA, 32 nt, Human
uuggaaauaaaaggugauucccuugguaaaaa

SEQ ID NO: 540854 - RNA, 32 nt, Human
uuggaaaucaaauuagaucauugacagaaaaa

SEQ ID NO: 540855 - RNA, 32 nt, Human
uuggaaaucagcuucuggaggaaugcauguca

SEQ ID NO: 540856 - RNA, 32 nt, Human
uuggaaaucagucauuacaguaaccgaaacca

SEQ ID NO: 540857 - RNA, 32 nt, Human
uuggaaaucugaagacuuucguuuacagcugu

SEQ ID NO: 540858 - RNA, 32 nt, Human
uuggaaaucuguggcccuggaggaggaacagg

SEQ ID NO: 540859 - RNA, 23 nt, Human
uuggaaaucugugugugugcggg

SEQ ID NO: 540860 - RNA, 32 nt, Human
uuggaaaugacagauugugaauuccaaggccc

SEQ ID NO: 540861 - RNA, 32 nt, Human
uuggaaaugacuagagaggcagaggagaaggg

SEQ ID NO: 540862 - RNA, 32 nt, Human
uuggaaaugacuuucagccucugccucagucu

SEQ ID NO: 540863 - RNA, 32 nt, Human
uuggaaaugggacaggucuuucagacucacag

SEQ ID NO: 540864 - RNA, 32 nt, Human
uuggaaauguaacuugaagcagcugcuuuaag

SEQ ID NO: 540865 - RNA, 31 nt, Human
uuggaacaaguguucagagcagacagaagca

SEQ ID NO: 540866 - RNA, 32 nt, Human
uuggaacacaacuuuuaucugugcacaauuuu

SEQ ID NO: 540867 - RNA, 32 nt, Human
uuggaacagaagaugauggccacuccgaacca

SEQ ID NO: 540868 - RNA, 32 nt, Human
uuggaacagaagcugggauagaugggcagcag

SEQ ID NO: 540869 - RNA, 32 nt, Human
uuggaacagugacaauaaaugagaccccuuua

SEQ ID NO: 540870 - RNA, 32 nt, Human
uuggaaccacuauuuucucaucacgacagcaa

SEQ ID NO: 540871 - RNA, 32 nt, Human
uuggaaccagggggaaccaggaaggggcuccu

SEQ ID NO: 540872 - RNA, 23 nt, Human
uuggaaccauuuguguucaguua

SEQ ID NO: 540873 - RNA, 32 nt, Human
uuggaaccccuccagggggaaccaaacauugu

SEQ ID NO: 540874 - RNA, 32 nt, Human
uuggaaccccuguuugaugagacauuugaauu

SEQ ID NO: 540875 - RNA, 32 nt, Human
uuggaaccccuuuguuauucaugaggauuaca

SEQ ID NO: 540876 - RNA, 32 nt, Human
uuggaacccugggcgucgagacaggaaggcag

SEQ ID NO: 540877 - RNA, 32 nt, Human
uuggaacccuuuagcuuuguuuuggaauggcc

SEQ ID NO: 540878 - RNA, 32 nt, Human
uuggaaccugcgccgugugcucugggggcugu

SEQ ID NO: 540879 - RNA, 32 nt, Human
uuggaaccugcucuccugcuugcuggucccug

SEQ ID NO: 540880 - RNA, 32 nt, Human
uuggaaccugggaggcagcaucugggggcagu

SEQ ID NO: 540881 - RNA, 32 nt, Human
uuggaacgguuguuguaaauaggccacauccu

SEQ ID NO: 540882 - RNA, 32 nt, Human
uuggaacgugcaccuggugaaacugcauugau

SEQ ID NO: 540883 - RNA, 32 nt, Human
uuggaacucugcagagaguccccagcaggaag

SEQ ID NO: 540884 - RNA, 32 nt, Human
uuggaacugccucuuauuuuaggcuguagaua

SEQ ID NO: 540885 - RNA, 32 nt, Human
uuggaacugcucagcuagcaggugcccccauc

SEQ ID NO: 540886 - RNA, 32 nt, Human
uuggaacuuacuaauuugggcuuuucaaaaac

SEQ ID NO: 540887 - RNA, 32 nt, Human
uuggaacuucuuuuuaaagucaucucaugguc

SEQ ID NO: 540888 - RNA, 32 nt, Human
uuggaacuugccugccuuuccauccauggcca

SEQ ID NO: 540889 - RNA, 32 nt, Human
uuggaagaaaaagaaaccacagaguccagccc

SEQ ID NO: 540890 - RNA, 32 nt, Human
uuggaagaaaucugguuugagacucugaaccu

SEQ ID NO: 540891 - RNA, 32 nt, Human
uuggaagaaauggcucauuugggaaacuacga

SEQ ID NO: 540892 - RNA, 32 nt, Human
uuggaagaaauguugaugccagaggggugagg

SEQ ID NO: 540893 - RNA, 32 nt, Human
uuggaagacauggauuuccuggaagacgugga

SEQ ID NO: 540894 - RNA, 19 nt, Human
uuggaagaccagggugggu

SEQ ID NO: 540895 - RNA, 32 nt, Human
uuggaagacccguguuuccuggaccgcgaauc

SEQ ID NO: 540896 - RNA, 32 nt, Human
uuggaagaccgaggcggguggaucacuugaag

SEQ ID NO: 540897 - RNA, 32 nt, Human
uuggaagagaaaaggauauggaacauacucuc

SEQ ID NO: 540898 - RNA, 32 nt, Human
uuggaagagaugaaagaucuucauggcuguuu

SEQ ID NO: 540899 - RNA, 30 nt, Human
uuggaagagcaucacagggcauaguuucac

SEQ ID NO: 540900 - RNA, 32 nt, Human
uuggaagaggaaaaugaugagacaucuaggag

SEQ ID NO: 540901 - RNA, 32 nt, Human
uuggaagaggaacauccagucacucaagugcu

SEQ ID NO: 540902 - RNA, 32 nt, Human
uuggaagaggaggaggaggaggagaaggagga

SEQ ID NO: 540903 - RNA, 21 nt, Human
uuggaagaggucugggugggg

SEQ ID NO: 540904 - RNA, 32 nt, Human
uuggaagaguagcugugguuguaaagcaguac

SEQ ID NO: 540905 - RNA, 31 nt, Human
uuggaagcaaaugacaucacagcaggucaga

SEQ ID NO: 540906 - RNA, 31 nt, Human
uuggaagcacuuuuucugcauacuuagauga

SEQ ID NO: 540907 - RNA, 22 nt, Human
uuggaagcagcugcugcugcug

SEQ ID NO: 540908 - RNA, 32 nt, Human
uuggaagcaggcugguagaguccuguaaauga

SEQ ID NO: 540909 - RNA, 32 nt, Human
uuggaagccagccugcugucgcucugugggga

SEQ ID NO: 540910 - RNA, 23 nt, Human
uuggaagcccuagacugcugcug

SEQ ID NO: 540911 - RNA, 32 nt, Human
uuggaagccgccagccccagaagaugccugcc

SEQ ID NO: 540912 - RNA, 32 nt, Human
uuggaagccuucucccugucauucucaacgcu

SEQ ID NO: 540913 - RNA, 32 nt, Human
uuggaagcuacacucaaagacacucccaccag

SEQ ID NO: 540914 - RNA, 32 nt, Human
uuggaagcuagcuccccuccucuccccuccac

SEQ ID NO: 540915 - RNA, 27 nt, Human
uuggaagcugaacugcuuuuguugcug

SEQ ID NO: 540916 - RNA, 21 nt, Human
uuggaagcugagauuacucug

SEQ ID NO: 540917 - RNA, 32 nt, Human
uuggaagcugggcuccuuaaaggaggccucua

SEQ ID NO: 540918 - RNA, 22 nt, Human
uuggaagcuggugcugcugcug

SEQ ID NO: 540919 - RNA, 32 nt, Human
uuggaaggaagcagaagcagagcugugguuuu

SEQ ID NO: 540920 - RNA, 32 nt, Human
uuggaaggagaagggagggaagagagcagaag

SEQ ID NO: 540921 - RNA, 32 nt, Human
uuggaaggaucagaucaaagagaaagcugggu

SEQ ID NO: 540922 - RNA, 32 nt, Human
uuggaaggccaagguagaagaaucacuugagc

SEQ ID NO: 540923 - RNA, 32 nt, Human
uuggaaggcccaaacccucucccuugaguggc

SEQ ID NO: 540924 - RNA, 32 nt, Human
uuggaaggcccagcuggcucagcacaaauccu

SEQ ID NO: 540925 - RNA, 32 nt, Human
uuggaaggccgaggcaggcggaucaccugagg

SEQ ID NO: 540926 - RNA, 32 nt, Human
uuggaaggccgaggcaggcggaucacgagguc

SEQ ID NO: 540927 - RNA, 32 nt, Human
uuggaaggccgaggcagguggaucaccugagg

SEQ ID NO: 540928 - RNA, 32 nt, Human
uuggaaggccgaggcagguggaucacuugaga

SEQ ID NO: 540929 - RNA, 32 nt, Human
uuggaaggccgaggcgggcagaucacuagagg

SEQ ID NO: 540930 - RNA, 32 nt, Human
uuggaaggccgaggcgggcggaucauuugagc

SEQ ID NO: 540931 - RNA, 32 nt, Human
uuggaaggccgaggcgggugggucaccugagg

SEQ ID NO: 540932 - RNA, 32 nt, Human
uuggaaggccgaggugggcagaucaucugagg

SEQ ID NO: 540933 - RNA, 32 nt, Human
uuggaaggccgagguggguggaucaccugagg

SEQ ID NO: 540934 - RNA, 22 nt, Human
uuggaaggccuccgucccaguc

SEQ ID NO: 540935 - RNA, 32 nt, Human
uuggaaggcugagacaggagaaucgcuugaac

SEQ ID NO: 540936 - RNA, 32 nt, Human
uuggaaggcugaggaggguggaucacgagguc

SEQ ID NO: 540937 - RNA, 32 nt, Human
uuggaaggcugaggcaggagaaucacuugaac

SEQ ID NO: 540938 - RNA, 32 nt, Human
uuggaaggcugaggcaggagaaucaucugaac

SEQ ID NO: 540939 - RNA, 32 nt, Human
uuggaaggcugaggcaggagaaucccuugaac

SEQ ID NO: 540940 - RNA, 32 nt, Human
uuggaaggcugaggcaggagaaucgcuugaac

SEQ ID NO: 540941 - RNA, 32 nt, Human
uuggaaggcugaggcaggagaauugcuugaac

SEQ ID NO: 540942 - RNA, 32 nt, Human
uuggaaggcugaggcaggaggaucacuuuagg

SEQ ID NO: 540943 - RNA, 32 nt, Human
uuggaaggcugaggcaggcagaucacuugagg

SEQ ID NO: 540944 - RNA, 32 nt, Human
uuggaaggcugaggcggguggaucacaagguc

SEQ ID NO: 540945 - RNA, 32 nt, Human
uuggaaggcuguagaucagagguucuaguucc

SEQ ID NO: 540946 - RNA, 32 nt, Human
uuggaagggaagggaggugggcagcagugggu

SEQ ID NO: 540947 - RNA, 32 nt, Human
uuggaagggacuggaggaaucauauucaauga

SEQ ID NO: 540948 - RNA, 32 nt, Human
uuggaagggagcaggaggaaggacugauacug

SEQ ID NO: 540949 - RNA, 32 nt, Human
uuggaagggcaucaugaccucuuggccucucc

SEQ ID NO: 540950 - RNA, 32 nt, Human
uuggaagggcugguggacugugcccuucuuuc

SEQ ID NO: 540951 - RNA, 32 nt, Human
uuggaaggggaagucucauacagguuauaggu

SEQ ID NO: 540952 - RNA, 32 nt, Human
uuggaaggggacccagagagaaaguccuggcu

SEQ ID NO: 540953 - RNA, 32 nt, Human
uuggaaggggaggcggggagagagugcuggag

SEQ ID NO: 540954 - RNA, 32 nt, Human
uuggaaguaacuuuggaaaagaauuccuucuu

SEQ ID NO: 540955 - RNA, 32 nt, Human
uuggaaguagggacccacugaguucccuccag

SEQ ID NO: 540956 - RNA, 32 nt, Human
uuggaaguccuggucugaauguggacccucuc

SEQ ID NO: 540957 - RNA, 22 nt, Human
uuggaagucgccggugcuguug

SEQ ID NO: 540958 - RNA, 32 nt, Human
uuggaagucuaagaucacacagccagcauggu

SEQ ID NO: 540959 - RNA, 25 nt, Human
uuggaagucucuggcuugugugcug

SEQ ID NO: 540960 - RNA, 32 nt, Human
uuggaagugagggucagagaggagucagagag

SEQ ID NO: 540961 - RNA, 21 nt, Human
uuggaaguuacgguauugcug

SEQ ID NO: 540962 - RNA, 21 nt, Human
uuggaaguucucuuggaccuu

SEQ ID NO: 540963 - RNA, 32 nt, Human
uuggaauaccaaaauugccuuaaaaauucccu

SEQ ID NO: 540964 - RNA, 32 nt, Human
uuggaauacccccauucuccuugccucuuagc

SEQ ID NO: 540965 - RNA, 32 nt, Human
uuggaauagaagguaaaauuucaaacagauug

SEQ ID NO: 540966 - RNA, 32 nt, Human
uuggaauccugugagcacuacucugaagguuu

SEQ ID NO: 540967 - RNA, 32 nt, Human
uuggaaucucaccacacgggugcucugaccug

SEQ ID NO: 540968 - RNA, 32 nt, Human
uuggaaucuccuccauuauuacccaggcuuug

SEQ ID NO: 540969 - RNA, 32 nt, Human
uuggaaugagggaggucucaagagauauaauu

SEQ ID NO: 540970 - RNA, 32 nt, Human
uuggaaugcuuuuccagggagagaggccaguu

SEQ ID NO: 540971 - RNA, 32 nt, Human
uuggaaugggguuugcuguucuucgggaacuu

SEQ ID NO: 540972 - RNA, 32 nt, Human
uuggaauguaacuccuggcacaguguuccugg

SEQ ID NO: 540973 - RNA, 22 nt, Human
uuggaauuacaggcgugagcca

SEQ ID NO: 540974 - RNA, 32 nt, Human
uuggaauuagauuuuucaaaacuaauaugugg

SEQ ID NO: 540975 - RNA, 32 nt, Human
uuggaauucauuggcuuccucuacccggccuc

SEQ ID NO: 540976 - RNA, 19 nt, Human
uuggaauuccaacugugga

SEQ ID NO: 540977 - RNA, 32 nt, Human
uuggaauucucaggaaugcauccuguggucua

SEQ ID NO: 540978 - RNA, 32 nt, Human
uuggaauuguccuugcucacaugcugccauca

SEQ ID NO: 540979 - RNA, 32 nt, Human
uuggaauuuggauagauuuaaaagugauagga

SEQ ID NO: 540980 - RNA, 20 nt, Human
uuggaauuuuccugggaccu

SEQ ID NO: 540981 - RNA, 18 nt, Human
uuggaauuuuggggcuuu

SEQ ID NO: 540982 - RNA, 32 nt, Human
uuggacaaaagcuuccggcuaaccagauucac

SEQ ID NO: 540983 - RNA, 32 nt, Human
uuggacaaaggaucagcacagcuggccuccag

SEQ ID NO: 540984 - RNA, 32 nt, Human
uuggacaauucagacuuuacuaaagcacaguu

SEQ ID NO: 540985 - RNA, 32 nt, Human
uuggacacaagaagacuugccuagaccacauc

SEQ ID NO: 540986 - RNA, 32 nt, Human
uuggacacagaagaaauccuagugcagccuuu

SEQ ID NO: 540987 - RNA, 32 nt, Human
uuggacacugaggcccucucugccuuuccugg

SEQ ID NO: 540988 - RNA, 32 nt, Human
uuggacacugcagcucuuuucaguuuuugcuu

SEQ ID NO: 540989 - RNA, 31 nt, Human
uuggacacuuaguuauuuaccaaagccuccg

SEQ ID NO: 540990 - RNA, 32 nt, Human
uuggacagaaaacugggccaggaaaaggcauc

SEQ ID NO: 540991 - RNA, 32 nt, Human
uuggacagaaaagaaggcucuggauuuaagcg

SEQ ID NO: 540992 - RNA, 32 nt, Human
uuggacagaaaaucacugugcugaucgggaag

SEQ ID NO: 540993 - RNA, 32 nt, Human
uuggacagaaggagguguuggggugagguggu

SEQ ID NO: 540994 - RNA, 32 nt, Human
uuggacagagggcgggagaugccauccccacu

SEQ ID NO: 540995 - RNA, 32 nt, Human
uuggacagcagcaccuuugagcgauggcggcg

SEQ ID NO: 540996 - RNA, 32 nt, Human
uuggacagcauugcagccaggagcuuaaaaga

SEQ ID NO: 540997 - RNA, 32 nt, Human
uuggacagcccugacccguccucugcaaccuc

SEQ ID NO: 540998 - RNA, 32 nt, Human
uuggacagccugggugugauggcaagacagua

SEQ ID NO: 540999 - RNA, 32 nt, Human
uuggacagcucuucuccucucuucaucccauc

SEQ ID NO: 541000 - RNA, 32 nt, Human
uuggacagcugacugaaugcagaacgguuuuu

SEQ ID NO: 541001 - RNA, 32 nt, Human
uuggacagggaugcagacacuguccauggcuc

SEQ ID NO: 541002 - RNA, 32 nt, Human
uuggacagggcuuucucucagguaggagaaau

SEQ ID NO: 541003 - RNA, 32 nt, Human
uuggacagggucucacuauguugcccaggcug

SEQ ID NO: 541004 - RNA, 21 nt, Human
uuggacagguaccuacugcug

SEQ ID NO: 541005 - RNA, 32 nt, Human
uuggacagguuguugcuuaaauaugcuaccau

SEQ ID NO: 541006 - RNA, 32 nt, Human
uuggacaguaggauucagcagagaaugagucc

SEQ ID NO: 541007 - RNA, 32 nt, Human
uuggacauguacugaaaauuaacacauguagu

SEQ ID NO: 541008 - RNA, 32 nt, Human
uuggaccaaagcaacaugagagcaaguacuuu

SEQ ID NO: 541009 - RNA, 32 nt, Human
uuggaccaagcagauaacaucacaagguguac

SEQ ID NO: 541010 - RNA, 32 nt, Human
uuggaccaagggcagaguggccacacuugaaa

SEQ ID NO: 541011 - RNA, 32 nt, Human
uuggaccacguaaggcauucucugauuuagug

SEQ ID NO: 541012 - RNA, 32 nt, Human
uuggaccacuauacuccagccuggcaacagag

SEQ ID NO: 541013 - RNA, 32 nt, Human
uuggaccacugcucuccagccugggcaacaga

SEQ ID NO: 541014 - RNA, 32 nt, Human
uuggaccagcuucucacacucacaccuuccua

SEQ ID NO: 541015 - RNA, 32 nt, Human
uuggaccagucugaauccagaggaucaggauc

SEQ ID NO: 541016 - RNA, 32 nt, Human
uuggaccaguguuugcuuagugucuucacugu

SEQ ID NO: 541017 - RNA, 32 nt, Human
uuggacccaagauugaaaacccaaggcagguu

SEQ ID NO: 541018 - RNA, 32 nt, Human
uuggacccagaccccugcccacugaccgcaac

SEQ ID NO: 541019 - RNA, 32 nt, Human
uuggacccaggcagcagccacagaggggccca

SEQ ID NO: 541020 - RNA, 28 nt, Human
uuggacccauagguagccucaucccugc

SEQ ID NO: 541021 - RNA, 32 nt, Human
uuggaccccucccagccugugaccuuugugac

SEQ ID NO: 541022 - RNA, 32 nt, Human
uuggaccccugccucucaacauagaugaaaau

SEQ ID NO: 541023 - RNA, 32 nt, Human
uuggaccccugccucuuaacauagaugaaaau

SEQ ID NO: 541024 - RNA, 18 nt, Human
uuggaccccuggggccuu

SEQ ID NO: 541025 - RNA, 32 nt, Human
uuggacccgagcgauccucccgcuucggccuc

SEQ ID NO: 541026 - RNA, 32 nt, Human
uuggacccgcagcugcugugcugcucugugcc

SEQ ID NO: 541027 - RNA, 32 nt, Human
uuggacccgggaggcggagguugcagugagcc

SEQ ID NO: 541028 - RNA, 20 nt, Human
uuggacccucaugggaucuu

SEQ ID NO: 541029 - RNA, 32 nt, Human
uuggacccucucuuggcaaagacaaccauagu

SEQ ID NO: 541030 - RNA, 32 nt, Human
uuggacccugccgaagcucccugccuuuaaua

SEQ ID NO: 541031 - RNA, 32 nt, Human
uuggacccuggagguagaggcugcagugagcc

SEQ ID NO: 541032 - RNA, 32 nt, Human
uuggacccuguagacccagcaggagccuggcc

SEQ ID NO: 541033 - RNA, 32 nt, Human
uuggacccuguccagcacagcuucuggcacag

SEQ ID NO: 541034 - RNA, 32 nt, Human
uuggaccuagcagcucaugccuguaaucucca

SEQ ID NO: 541035 - RNA, 32 nt, Human
uuggaccuaggagguggagguugcagugagcu

SEQ ID NO: 541036 - RNA, 32 nt, Human
uuggaccuauauggccaugcucuggcucuacc

SEQ ID NO: 541037 - RNA, 32 nt, Human
uuggaccucauagcuuauuuuaguuaaucuuu

SEQ ID NO: 541038 - RNA, 32 nt, Human
uuggaccuccuuggccugacccauucuguggg

SEQ ID NO: 541039 - RNA, 32 nt, Human
uuggaccucuuugguucucuccccuuucaagu

SEQ ID NO: 541040 - RNA, 32 nt, Human
uuggaccugggagguggagguugcagugagcu

SEQ ID NO: 541041 - RNA, 32 nt, Human
uuggaccuuauggucacccaacucaaggacag

SEQ ID NO: 541042 - RNA, 32 nt, Human
uuggaccuucuuucuguucucuuuacucuucu

SEQ ID NO: 541043 - RNA, 23 nt, Human
uuggacgcagcccccugcugcug

SEQ ID NO: 541044 - RNA, 32 nt, Human
uuggacggaacagauccggggacucucuucca

SEQ ID NO: 541045 - RNA, 32 nt, Human
uuggacggagucuugcucugucucccaggcug

SEQ ID NO: 541046 - RNA, 32 nt, Human
uuggacggaguuucaccauguuggccaggcug

SEQ ID NO: 541047 - RNA, 32 nt, Human
uuggacgggaagagacaggcaggagucggaau

SEQ ID NO: 541048 - RNA, 31 nt, Human
uuggacgggcacuuccuugacaauuccuauu

SEQ ID NO: 541049 - RNA, 32 nt, Human
uuggacggggcaucaguucuucauuuguggag

SEQ ID NO: 541050 - RNA, 32 nt, Human
uuggacuacagguacaugccaccacaccuggc

SEQ ID NO: 541051 - RNA, 32 nt, Human
uuggacuaccagaaucaagcacucuuuuggaa

SEQ ID NO: 541052 - RNA, 32 nt, Human
uuggacuacguucuuggcuccagaccuggaau

SEQ ID NO: 541053 - RNA, 32 nt, Human
uuggacuauggagugcaccaaagagaaugccc

SEQ ID NO: 541054 - RNA, 32 nt, Human
uuggacucaaacaauccucccaucucgccucc

SEQ ID NO: 541055 - RNA, 32 nt, Human
uuggacucacccagaucuagugcagggacaca

SEQ ID NO: 541056 - RNA, 32 nt, Human
uuggacucacuguggcuggacggaggggaccc

SEQ ID NO: 541057 - RNA, 32 nt, Human
uuggacucaggccucagagccuggccugguug

SEQ ID NO: 541058 - RNA, 32 nt, Human
uuggacucauguccucauugcuucacucaauu

SEQ ID NO: 541059 - RNA, 32 nt, Human
uuggacucauugacuccagcuaaugaagauca

SEQ ID NO: 541060 - RNA, 32 nt, Human
uuggacucccaaagugcugggauuacagacgu

SEQ ID NO: 541061 - RNA, 32 nt, Human
uuggacucccaaagugcugggauuacaggcuu

SEQ ID NO: 541062 - RNA, 32 nt, Human
uuggacucccacucucaagacuccucacuugc

SEQ ID NO: 541063 - RNA, 32 nt, Human
uuggacucucccagguuccacagaacaguaau

SEQ ID NO: 541064 - RNA, 32 nt, Human
uuggacucuccccucuuauguaccucuuuuag

SEQ ID NO: 541065 - RNA, 32 nt, Human
uuggacucugccugggcuggagucuagggcug

SEQ ID NO: 541066 - RNA, 32 nt, Human
uuggacucugccuucaaacaaaggcaguucag

SEQ ID NO: 541067 - RNA, 32 nt, Human
uuggacucuguaacucauaggugcauucuuuu

SEQ ID NO: 541068 - RNA, 32 nt, Human
uuggacucuuucccaucuccccuggggagccu

SEQ ID NO: 541069 - RNA, 32 nt, Human
uuggacugagucuugcucuguugcccaugcuu

SEQ ID NO: 541070 - RNA, 32 nt, Human
uuggacugauucccagucuccugggucaagcc

SEQ ID NO: 541071 - RNA, 32 nt, Human
uuggacuggacucaggcuggaggcagauagac

SEQ ID NO: 541072 - RNA, 32 nt, Human
uuggacuggacuuugaugagauauaaucucau

SEQ ID NO: 541073 - RNA, 19 nt, Human
uuggacugguggcaucaug

SEQ ID NO: 541074 - RNA, 32 nt, Human
uuggacuggugggaacugggaacacuggagac

SEQ ID NO: 541075 - RNA, 32 nt, Human
uuggacuguaagggauugaaggggguaccuua

SEQ ID NO: 541076 - RNA, 32 nt, Human
uuggacuguggggcauguggccgcugcaguuc

SEQ ID NO: 541077 - RNA, 32 nt, Human
uuggacuguuuaugaccuacuggcuccuuuaa

SEQ ID NO: 541078 - RNA, 32 nt, Human
uuggacuuaacacccuugccuuucugggacuu

SEQ ID NO: 541079 - RNA, 32 nt, Human
uuggacuucaguccucccucggggacucaccu

SEQ ID NO: 541080 - RNA, 32 nt, Human
uuggacuugagacccuucacaccccagcagcg

SEQ ID NO: 541081 - RNA, 32 nt, Human
uuggacuugauucaaagaaugcaguuuguguu

SEQ ID NO: 541082 - RNA, 23 nt, Human
uuggacuugccaugagguguuga

SEQ ID NO: 541083 - RNA, 32 nt, Human
uuggacuugggaggcgguuguugcagugagcu

SEQ ID NO: 541084 - RNA, 32 nt, Human
uuggacuuggguuccuggauggugggauuguu

SEQ ID NO: 541085 - RNA, 32 nt, Human
uuggacuuuacguuuaaacacaauucaauccg

SEQ ID NO: 541086 - RNA, 32 nt, Human
uuggacuuuuuggauuuuacaggacaggacua

SEQ ID NO: 541087 - RNA, 32 nt, Human
uuggagaaaccaggucggaaauaccucuccag

SEQ ID NO: 541088 - RNA, 32 nt, Human
uuggagaacucauguaacccuccuguuucuua

SEQ ID NO: 541089 - RNA, 32 nt, Human
uuggagaacugaggcugaggguagagggagua

SEQ ID NO: 541090 - RNA, 32 nt, Human
uuggagaagaaccuagagagacagggaagguu

SEQ ID NO: 541091 - RNA, 32 nt, Human
uuggagaagcuacagccugugcucaguugagu

SEQ ID NO: 541092 - RNA, 32 nt, Human
uuggagaaggcaaggaaggaggcggugacaga

SEQ ID NO: 541093 - RNA, 32 nt, Human
uuggagaagguagaggaggagaaagaauccaa

SEQ ID NO: 541094 - RNA, 32 nt, Human
uuggagaauagggaugaugauagcauggaugu

SEQ ID NO: 541095 - RNA, 32 nt, Human
uuggagacaagaaaauuuuauuaugacucuag

SEQ ID NO: 541096 - RNA, 24 nt, Human
uuggagacaagccugggcaacaug

SEQ ID NO: 541097 - RNA, 32 nt, Human
uuggagacaagccugggcaacauggugaaacu

SEQ ID NO: 541098 - RNA, 32 nt, Human
uuggagacagaccuacacuaccaguuuucacc

SEQ ID NO: 541099 - RNA, 32 nt, Human
uuggagacagccgccaccccacaggccgggcu

SEQ ID NO: 541100 - RNA, 32 nt, Human
uuggagacaggcaggaggugggggaagagcug

SEQ ID NO: 541101 - RNA, 24 nt, Human
uuggagaccaaccugggcaacaua

SEQ ID NO: 541102 - RNA, 32 nt, Human
uuggagaccaaccugggcaacauagcaagacc

SEQ ID NO: 541103 - RNA, 32 nt, Human
uuggagaccaaccugggcaacauagugagacc

SEQ ID NO: 541104 - RNA, 32 nt, Human
uuggagaccagccagagcaacacagugagacc

SEQ ID NO: 541105 - RNA, 24 nt, Human
uuggagaccagccuaggcaacaug

SEQ ID NO: 541106 - RNA, 32 nt, Human
uuggagaccagccuaggcaacauggcgaaacc

SEQ ID NO: 541107 - RNA, 32 nt, Human
uuggagaccagccugaccaacauggacaaacc

SEQ ID NO: 541108 - RNA, 32 nt, Human
uuggagaccagccugaccaacauggagaaacc

SEQ ID NO: 541109 - RNA, 24 nt, Human
uuggagaccagccugagcaacaua

SEQ ID NO: 541110 - RNA, 32 nt, Human
uuggagaccagccugagcaacauagugagacc

SEQ ID NO: 541111 - RNA, 32 nt, Human
uuggagaccagccugcccaacaugaugaaacc

SEQ ID NO: 541112 - RNA, 24 nt, Human
uuggagaccagccugcgcaacgua

SEQ ID NO: 541113 - RNA, 24 nt, Human
uuggagaccagccuggaugacaua

SEQ ID NO: 541114 - RNA, 32 nt, Human
uuggagaccagccuggaugacauaaugagauu

SEQ ID NO: 541115 - RNA, 24 nt, Human
uuggagaccagccuggccaacaua

SEQ ID NO: 541116 - RNA, 32 nt, Human
uuggagaccagccuggccaacauagugaaacc

SEQ ID NO: 541117 - RNA, 24 nt, Human
uuggagaccagccuggccaacaug

SEQ ID NO: 541118 - RNA, 32 nt, Human
uuggagaccagccuggccaacauggcgaaacc

SEQ ID NO: 541119 - RNA, 32 nt, Human
uuggagaccagccuggccaacauggugaaacc

SEQ ID NO: 541120 - RNA, 32 nt, Human
uuggagaccagccuggccaacguggcaaaacc

SEQ ID NO: 541121 - RNA, 32 nt, Human
uuggagaccagccuggccaagauggugaaacc

SEQ ID NO: 541122 - RNA, 24 nt, Human
uuggagaccagccuggccaauaug

SEQ ID NO: 541123 - RNA, 22 nt, Human
uuggagaccagccugggcaaca

SEQ ID NO: 541124 - RNA, 32 nt, Human
uuggagaccagccugggcaacacagugagaac

SEQ ID NO: 541125 - RNA, 24 nt, Human
uuggagaccagccugggcaacaua

SEQ ID NO: 541126 - RNA, 32 nt, Human
uuggagaccagccugggcaacauagcaagacu

SEQ ID NO: 541127 - RNA, 32 nt, Human
uuggagaccagccugggcaacauagugagacc

SEQ ID NO: 541128 - RNA, 24 nt, Human
uuggagaccagccugggcaacaug

SEQ ID NO: 541129 - RNA, 32 nt, Human
uuggagaccagccugggcaacauggcaaaacu

SEQ ID NO: 541130 - RNA, 32 nt, Human
uuggagaccagccugggcaacauggugagacc

SEQ ID NO: 541131 - RNA, 32 nt, Human
uuggagaccaggcuggccaacacggugaaacc

SEQ ID NO: 541132 - RNA, 32 nt, Human
uuggagaccagucuggccaauauggugaaacc

SEQ ID NO: 541133 - RNA, 32 nt, Human
uuggagaccagucugggcaacauggugaaacc

SEQ ID NO: 541134 - RNA, 32 nt, Human
uuggagaccaugucaggaaagaagcguaccca

SEQ ID NO: 541135 - RNA, 24 nt, Human
uuggagaccauuuccugugccaga

SEQ ID NO: 541136 - RNA, 32 nt, Human
uuggagaccugccugggcaacauagcaaggcc

SEQ ID NO: 541137 - RNA, 32 nt, Human
uuggagaccuggaggagcaggagacacaggag

SEQ ID NO: 541138 - RNA, 32 nt, Human
uuggagacggccaagugaaggagccagugccc

SEQ ID NO: 541139 - RNA, 32 nt, Human
uuggagacuagaaaauuacuuucccccuuuga

SEQ ID NO: 541140 - RNA, 32 nt, Human
uuggagacucaaaagacuaugaagugaucacu

SEQ ID NO: 541141 - RNA, 21 nt, Human
uuggagacucuguggggccuu

SEQ ID NO: 541142 - RNA, 32 nt, Human
uuggagacugaagagaaagagagagaggagaa

SEQ ID NO: 541143 - RNA, 20 nt, Human
uuggagacuuccugggacuu

SEQ ID NO: 541144 - RNA, 32 nt, Human
uuggagagaaaaucauuggucauuccauuaaa

SEQ ID NO: 541145 - RNA, 32 nt, Human
uuggagagaagagggacgacuggagaaucguc

SEQ ID NO: 541146 - RNA, 32 nt, Human
uuggagagaagggagagggcccgucggacagc

SEQ ID NO: 541147 - RNA, 32 nt, Human
uuggagagacaagaauuggucuccagcugccu

SEQ ID NO: 541148 - RNA, 32 nt, Human
uuggagagauagagucacuauuacugauaugg

SEQ ID NO: 541149 - RNA, 32 nt, Human
uuggagagaugagcuguaucaccugcagaugu

SEQ ID NO: 541150 - RNA, 32 nt, Human
uuggagagaugggguuucaccauguugccuag

SEQ ID NO: 541151 - RNA, 32 nt, Human
uuggagagcacuuggcccugccacugcccagg

SEQ ID NO: 541152 - RNA, 32 nt, Human
uuggagagcagacugggcaacauagcgagacc

SEQ ID NO: 541153 - RNA, 32 nt, Human
uuggagagcucaggaucuggccccagagaaag

SEQ ID NO: 541154 - RNA, 32 nt, Human
uuggagaggaaagaggaacggugaagacaagc

SEQ ID NO: 541155 - RNA, 32 nt, Human
uuggagaggaggcagccagcaguggcagucca

SEQ ID NO: 541156 - RNA, 32 nt, Human
uuggagaggcagaugacauuauaccugauuuu

SEQ ID NO: 541157 - RNA, 32 nt, Human
uuggagaggcagcaugauggaguggggauaac

SEQ ID NO: 541158 - RNA, 32 nt, Human
uuggagagggccugccugggacugagggggcc

SEQ ID NO: 541159 - RNA, 32 nt, Human
uuggagagucacuguucaccucagccuauuca

SEQ ID NO: 541160 - RNA, 32 nt, Human
uuggagaguggaggcagcagagaugggaaugg

SEQ ID NO: 541161 - RNA, 32 nt, Human
uuggagauaacuuggaguuuauuugaacauca

SEQ ID NO: 541162 - RNA, 32 nt, Human
uuggagauagaaaggcuccuccccaccaugua

SEQ ID NO: 541163 - RNA, 32 nt, Human
uuggagauagcaucaucacagagucucaggga

SEQ ID NO: 541164 - RNA, 32 nt, Human
uuggagaucagccuggcuaacuaacauggcua

SEQ ID NO: 541165 - RNA, 24 nt, Human
uuggagaucagccugggcaacaug

SEQ ID NO: 541166 - RNA, 32 nt, Human
uuggagaucagccugggcaacauggccagacc

SEQ ID NO: 541167 - RNA, 32 nt, Human
uuggagauccugcuucccagaccacagcugug

SEQ ID NO: 541168 - RNA, 32 nt, Human
uuggagaugaggaacagacccaggaagaugac

SEQ ID NO: 541169 - RNA, 32 nt, Human
uuggagauggaacaugccuccucuccauucag

SEQ ID NO: 541170 - RNA, 32 nt, Human
uuggagaugguucugcccacucugauuucucu

SEQ ID NO: 541171 - RNA, 32 nt, Human
uuggagauguuacugaaguugauugagcaaua

SEQ ID NO: 541172 - RNA, 32 nt, Human
uuggagauugacaaaaagguaacacgugaugu

SEQ ID NO: 541173 - RNA, 32 nt, Human
uuggagauugagcagaugaggcuugggaugcc

SEQ ID NO: 541174 - RNA, 23 nt, Human
uuggagauuuauccugugcaaga

SEQ ID NO: 541175 - RNA, 32 nt, Human
uuggagcaaaggcaagggcagauggaaaguuc

SEQ ID NO: 541176 - RNA, 32 nt, Human
uuggagcaccugccggcagaguuccccagccu

SEQ ID NO: 541177 - RNA, 32 nt, Human
uuggagcacuauauguacucucuggacuacuu

SEQ ID NO: 541178 - RNA, 32 nt, Human
uuggagcaggaugagggaauccugucaccauc

SEQ ID NO: 541179 - RNA, 32 nt, Human
uuggagcaggauggcuccucuaagaaucucac

SEQ ID NO: 541180 - RNA, 32 nt, Human
uuggagcaggauucagaaggggcuccuguccu

SEQ ID NO: 541181 - RNA, 32 nt, Human
uuggagcauccauggauugcagugaucauuaa

SEQ ID NO: 541182 - RNA, 32 nt, Human
uuggagcaugccauuggaaaacccacccccac

SEQ ID NO: 541183 - RNA, 32 nt, Human
uuggagccaagcucuuagguuccucuuauuug

SEQ ID NO: 541184 - RNA, 25 nt, Human
uuggagccacguguuuuuauugcug

SEQ ID NO: 541185 - RNA, 32 nt, Human
uuggagccacugcucaccucaaacaguacaaa

SEQ ID NO: 541186 - RNA, 32 nt, Human
uuggagccagagauuucaugucugauugaugg

SEQ ID NO: 541187 - RNA, 23 nt, Human
uuggagccagccaggauggggug

SEQ ID NO: 541188 - RNA, 32 nt, Human
uuggagccagcuguuuccaguuguuacugaag

SEQ ID NO: 541189 - RNA, 32 nt, Human
uuggagccaggaacaggcaggagcccagcccu

SEQ ID NO: 541190 - RNA, 32 nt, Human
uuggagccaggaguuugagaccagccugggca

SEQ ID NO: 541191 - RNA, 32 nt, Human
uuggagccauuuuuaguggggagaacucuugg

SEQ ID NO: 541192 - RNA, 32 nt, Human
uuggagcccacagucuccuucacugcacgugu

SEQ ID NO: 541193 - RNA, 32 nt, Human
uuggagcccugccucugagccuggacgggaag

SEQ ID NO: 541194 - RNA, 21 nt, Human
uuggagccgccaugcagcccc

SEQ ID NO: 541195 - RNA, 32 nt, Human
uuggagccucgggcuccuggggugcagggugc

SEQ ID NO: 541196 - RNA, 32 nt, Human
uuggagccugaggcaccaugccuaccuagggc

SEQ ID NO: 541197 - RNA, 32 nt, Human
uuggagccugcagggcaggucaggcugguuca

SEQ ID NO: 541198 - RNA, 22 nt, Human
uuggagccugguccuugcuuug

SEQ ID NO: 541199 - RNA, 32 nt, Human
uuggagccuugugguggaauccccuuuucccc

SEQ ID NO: 541200 - RNA, 22 nt, Human
uuggagccuuucugcugagcua

SEQ ID NO: 541201 - RNA, 32 nt, Human
uuggagccuuucugcugagcuagaccaucuuu

SEQ ID NO: 541202 - RNA, 32 nt, Human
uuggagccuuuggaccuauagcucaaggccag

SEQ ID NO: 541203 - RNA, 32 nt, Human
uuggagcuaggccugguggcgugcucuagccc

SEQ ID NO: 541204 - RNA, 32 nt, Human
uuggagcuauucaggaauugcagagaaaugca

SEQ ID NO: 541205 - RNA, 32 nt, Human
uuggagcucacuggucccugccucuggggcuu

SEQ ID NO: 541206 - RNA, 32 nt, Human
uuggagcuccuagagggaagcuucuggaaagg

SEQ ID NO: 541207 - RNA, 18 nt, Human
uuggagcuccuggggccu

SEQ ID NO: 541208 - RNA, 19 nt, Human
uuggagcugaaggaaccug

SEQ ID NO: 541209 - RNA, 18 nt, Human
uuggagcugaggggcaag

SEQ ID NO: 541210 - RNA, 17 nt, Human
uuggagcugccgccugg

SEQ ID NO: 541211 - RNA, 32 nt, Human
uuggagcugccugucugcauguauccucuggc

SEQ ID NO: 541212 - RNA, 23 nt, Human
uuggagcuggacggagaaacugg

SEQ ID NO: 541213 - RNA, 19 nt, Human
uuggagcugggaagccugg

SEQ ID NO: 541214 - RNA, 32 nt, Human
uuggagcugggaggguggaggugugggagcug

SEQ ID NO: 541215 - RNA, 21 nt, Human
uuggagcugugcaaauguuaa

SEQ ID NO: 541216 - RNA, 32 nt, Human
uuggagcuucagagccauggcaaccaaggagu

SEQ ID NO: 541217 - RNA, 20 nt, Human
uuggagcuuccugggcccuu

SEQ ID NO: 541218 - RNA, 31 nt, Human
uuggaggaaacaaucucugccaccaccaagu

SEQ ID NO: 541219 - RNA, 19 nt, Human
uuggaggaauaucguaggu

SEQ ID NO: 541220 - RNA, 20 nt, Human
uuggaggacagcagugaggu

SEQ ID NO: 541221 - RNA, 18 nt, Human
uuggaggagaccagggug

SEQ ID NO: 541222 - RNA, 32 nt, Human
uuggaggagagcagcucccacuguggggacac

SEQ ID NO: 541223 - RNA, 32 nt, Human
uuggaggagagggagggggaggacauggcacc

SEQ ID NO: 541224 - RNA, 20 nt, Human
uuggaggagaugacuguggu

SEQ ID NO: 541225 - RNA, 23 nt, Human
uuggaggagaugagaaggaagug

SEQ ID NO: 541226 - RNA, 32 nt, Human
uuggaggagcagugguggggguagcugucacc

SEQ ID NO: 541227 - RNA, 21 nt, Human
uuggaggagccgcgugccaga

SEQ ID NO: 541228 - RNA, 20 nt, Human
uuggaggagcuggaaaggug

SEQ ID NO: 541229 - RNA, 19 nt, Human
uuggaggaggaggaggagg

SEQ ID NO: 541230 - RNA, 32 nt, Human
uuggaggaggaggaggaggaggagaggggccu

SEQ ID NO: 541231 - RNA, 32 nt, Human
uuggaggaggcagagccaugaccaaggggacc

SEQ ID NO: 541232 - RNA, 23 nt, Human
uuggaggagggaggcaggaggug

SEQ ID NO: 541233 - RNA, 22 nt, Human
uuggaggagggaguaagaggug

SEQ ID NO: 541234 - RNA, 19 nt, Human
uuggaggagggaguggagu

SEQ ID NO: 541235 - RNA, 32 nt, Human
uuggaggagggcaaaaguuggaaguaagaagu

SEQ ID NO: 541236 - RNA, 32 nt, Human
uuggaggagggcaagcugccacuggugucagc

SEQ ID NO: 541237 - RNA, 32 nt, Human
uuggaggagggcagaggcagugugggcugaug

SEQ ID NO: 541238 - RNA, 32 nt, Human
uuggaggagguggcggcgggcagaggugaugu

SEQ ID NO: 541239 - RNA, 32 nt, Human
uuggaggaggugggacuugagcuggacccaug

SEQ ID NO: 541240 - RNA, 32 nt, Human
uuggaggauacccagugucuauucuggguuag

SEQ ID NO: 541241 - RNA, 22 nt, Human
uuggaggauccugaggugggug

SEQ ID NO: 541242 - RNA, 31 nt, Human
uuggaggaucuacuggagguguuuguaagga

SEQ ID NO: 541243 - RNA, 22 nt, Human
uuggaggauggcuucugcugcu

SEQ ID NO: 541244 - RNA, 22 nt, Human
uuggaggauggugggagaagug

SEQ ID NO: 541245 - RNA, 32 nt, Human
uuggaggauucuggguacauuuugucauggaa

SEQ ID NO: 541246 - RNA, 32 nt, Human
uuggaggcagcuauugguugcuuucuuggagg

SEQ ID NO: 541247 - RNA, 32 nt, Human
uuggaggccacuggagggaggggugagcaugg

SEQ ID NO: 541248 - RNA, 32 nt, Human
uuggaggccagcccaguguggaagagagguac

SEQ ID NO: 541249 - RNA, 32 nt, Human
uuggaggccagccuggaucugucucucccuuc

SEQ ID NO: 541250 - RNA, 32 nt, Human
uuggaggccagccuggccaaaauggcaaaacc

SEQ ID NO: 541251 - RNA, 22 nt, Human
uuggaggccagccugggcaaca

SEQ ID NO: 541252 - RNA, 32 nt, Human
uuggaggccagccugggcaacacagcaagacc

SEQ ID NO: 541253 - RNA, 32 nt, Human
uuggaggccaggaguuggagaucagccugggc

SEQ ID NO: 541254 - RNA, 32 nt, Human
uuggaggcccugcucaggaggcccugaccgug

SEQ ID NO: 541255 - RNA, 19 nt, Human
uuggaggcccuggggccuu

SEQ ID NO: 541256 - RNA, 21 nt, Human
uuggaggccuccaagcugcug

SEQ ID NO: 541257 - RNA, 32 nt, Human
uuggaggccugguccuggaacugagccggggc

SEQ ID NO: 541258 - RNA, 32 nt, Human
uuggaggccuucaucccucucuacgauaaggu

SEQ ID NO: 541259 - RNA, 32 nt, Human
uuggaggcgagaagagagaaugugcugucuau

SEQ ID NO: 541260 - RNA, 18 nt, Human
uuggaggcucuuuucuca

SEQ ID NO: 541261 - RNA, 32 nt, Human
uuggaggcugacuguagggcugggcagcuggg

SEQ ID NO: 541262 - RNA, 32 nt, Human
uuggaggcugaguucugguucaugcagacaaa

SEQ ID NO: 541263 - RNA, 32 nt, Human
uuggaggcugcaguaagcuaugaucaugccac

SEQ ID NO: 541264 - RNA, 32 nt, Human
uuggaggcuggcugggccucuguccagucccc

SEQ ID NO: 541265 - RNA, 27 nt, Human
uuggaggcuuuaaaguucuuucuguug

SEQ ID NO: 541266 - RNA, 32 nt, Human
uuggagggacuggacuccucuccagcucccca

SEQ ID NO: 541267 - RNA, 32 nt, Human
uuggagggagaagggaauugcacuucacacug

SEQ ID NO: 541268 - RNA, 32 nt, Human
uuggagggagaggcaccuuucucauccucucu

SEQ ID NO: 541269 - RNA, 20 nt, Human
uuggagggagcggaugggug

SEQ ID NO: 541270 - RNA, 32 nt, Human
uuggagggaggaagaaagggagccggcguuca

SEQ ID NO: 541271 - RNA, 32 nt, Human
uuggagggaggaaucccuuccucccggugauc

SEQ ID NO: 541272 - RNA, 32 nt, Human
uuggagggaggugaguuuagggagggccagga

SEQ ID NO: 541273 - RNA, 32 nt, Human
uuggagggauccucuucucuuaggauuaaugu

SEQ ID NO: 541274 - RNA, 32 nt, Human
uuggagggcaggcacgaagaacagugagauug

SEQ ID NO: 541275 - RNA, 32 nt, Human
uuggagggcugaagcaggaggauugcuugagg

SEQ ID NO: 541276 - RNA, 32 nt, Human
uuggagggcugagaaggggcagcucugaauac

SEQ ID NO: 541277 - RNA, 22 nt, Human
uuggaggggagaggggaaggug

SEQ ID NO: 541278 - RNA, 32 nt, Human
uuggagggucaucacucuacacccucaggugc

SEQ ID NO: 541279 - RNA, 24 nt, Human
uuggagggugcccuccuucugcug

SEQ ID NO: 541280 - RNA, 32 nt, Human
uuggagggugggcagaagaugggcagucggca

SEQ ID NO: 541281 - RNA, 32 nt, Human
uuggaggguugcauggcggcugggcaaaggug

SEQ ID NO: 541282 - RNA, 32 nt, Human
uuggagguaagagagaaaaugaaagaacaccu

SEQ ID NO: 541283 - RNA, 32 nt, Human
uuggagguagcagugcuagcucugccuucagg

SEQ ID NO: 541284 - RNA, 32 nt, Human
uuggagguagguggugagucugagaaaggggc

SEQ ID NO: 541285 - RNA, 32 nt, Human
uuggaggucuggauccagucucucuuuguuuu

SEQ ID NO: 541286 - RNA, 32 nt, Human
uuggaggugaccauccaggcaggccuggcuca

SEQ ID NO: 541287 - RNA, 19 nt, Human
uuggaggugacccaggaga

SEQ ID NO: 541288 - RNA, 32 nt, Human
uuggaggugcuuaagcagaagcauuaacuucu

SEQ ID NO: 541289 - RNA, 32 nt, Human
uuggagguuaaggcauacgagagcagaggucu

SEQ ID NO: 541290 - RNA, 32 nt, Human
uuggagguugacuaauaagaaaguuggcauaa

SEQ ID NO: 541291 - RNA, 32 nt, Human
uuggagguuucucggccuuuucugugccacuu

SEQ ID NO: 541292 - RNA, 32 nt, Human
uuggaguagcccguguguggaauucuaaagug

SEQ ID NO: 541293 - RNA, 32 nt, Human
uuggaguagggugggccccaauucaaggacug

SEQ ID NO: 541294 - RNA, 32 nt, Human
uuggaguauuucaucagcugaaaagugauucu

SEQ ID NO: 541295 - RNA, 32 nt, Human
uuggagucaaacacuggaugcagaaauuuugg

SEQ ID NO: 541296 - RNA, 32 nt, Human
uuggagucaaugcucucuagaaaacuaaaucc

SEQ ID NO: 541297 - RNA, 32 nt, Human
uuggagucacccauguggauaugauuuucagc

SEQ ID NO: 541298 - RNA, 32 nt, Human
uuggagucagucauuuuccucaucuagcugaa

SEQ ID NO: 541299 - RNA, 32 nt, Human
uuggagucaucuuaucuauuacuccaaaccuc

SEQ ID NO: 541300 - RNA, 24 nt, Human
uuggaguccagccugggcaacaua

SEQ ID NO: 541301 - RNA, 32 nt, Human
uuggagucccugaaggacccaggauuugcugg

SEQ ID NO: 541302 - RNA, 32 nt, Human
uuggaguccuggaagagagagaugagccaggg

SEQ ID NO: 541303 - RNA, 32 nt, Human
uuggaguccuggucccccuccucccuggcccu

SEQ ID NO: 541304 - RNA, 21 nt, Human
uuggagucucagggcagggug

SEQ ID NO: 541305 - RNA, 32 nt, Human
uuggagucucuuucucagacuuccucagcgca

SEQ ID NO: 541306 - RNA, 32 nt, Human
uuggagucugcuggugcgguguuuacacacca

SEQ ID NO: 541307 - RNA, 32 nt, Human
uuggagucuuaggcaucucugguacagugggg

SEQ ID NO: 541308 - RNA, 32 nt, Human
uuggagugaaguuuaauguugccaauggaggu

SEQ ID NO: 541309 - RNA, 32 nt, Human
uuggagugaguagauuugaggguccaguuaug

SEQ ID NO: 541310 - RNA, 21 nt, Human
uuggagugauggaaagucugg

SEQ ID NO: 541311 - RNA, 32 nt, Human
uuggagugccgggaaaaguuccagggucccca

SEQ ID NO: 541312 - RNA, 32 nt, Human
uuggagugcugcacaaacaaacauaagagcaa

SEQ ID NO: 541313 - RNA, 32 nt, Human
uuggaguggcugcuucugcuauagagaacauu

SEQ ID NO: 541314 - RNA, 32 nt, Human
uuggaguggguggccaucaugcauggccuggg

SEQ ID NO: 541315 - RNA, 32 nt, Human
uuggaguucaaaggaacaccagcucugaaaac

SEQ ID NO: 541316 - RNA, 32 nt, Human
uuggaguucacuccaaucauccaguggucccu

SEQ ID NO: 541317 - RNA, 32 nt, Human
uuggaguuccucagagcuuacuauacgcgguc

SEQ ID NO: 541318 - RNA, 32 nt, Human
uuggaguuccuucccuuccagaguccuuauug

SEQ ID NO: 541319 - RNA, 32 nt, Human
uuggaguugaguccugccuucuaccuccuugc

SEQ ID NO: 541320 - RNA, 32 nt, Human
uuggaguuggagggugagagaaaaugaauucu

SEQ ID NO: 541321 - RNA, 32 nt, Human
uuggaguugguuagauuggaccucuuuuacug

SEQ ID NO: 541322 - RNA, 32 nt, Human
uuggaguuuaauccuuugcuucaucuuucuac

SEQ ID NO: 541323 - RNA, 21 nt, Human
uuggaguuuccagcagggugg

SEQ ID NO: 541324 - RNA, 32 nt, Human
uuggaguuuccagcaggguggugugcaccacu

SEQ ID NO: 541325 - RNA, 32 nt, Human
uuggaguuugggguauaaaacacuccucccug

SEQ ID NO: 541326 - RNA, 32 nt, Human
uuggauaaaauggcuuuuccacauugcaacuu

SEQ ID NO: 541327 - RNA, 32 nt, Human
uuggauaacaacugcacuccagccuggaugac

SEQ ID NO: 541328 - RNA, 32 nt, Human
uuggauaaccacccccucaaacugagaccugg

SEQ ID NO: 541329 - RNA, 32 nt, Human
uuggauaacgacugcacuccagccuggaugac

SEQ ID NO: 541330 - RNA, 32 nt, Human
uuggauaagcauaucaagacccuucagagauu

SEQ ID NO: 541331 - RNA, 32 nt, Human
uuggauaauccccuccuugggggagagggauu

SEQ ID NO: 541332 - RNA, 21 nt, Human
uuggauaccaaagguuucuca

SEQ ID NO: 541333 - RNA, 32 nt, Human
uuggauaccuauuuaaauguguguucuguuuu

SEQ ID NO: 541334 - RNA, 20 nt, Human
uuggauaccuggcccgggau

SEQ ID NO: 541335 - RNA, 32 nt, Human
uuggauacugccagucccaggaggaaguagcc

SEQ ID NO: 541336 - RNA, 32 nt, Human
uuggauagagggcuggugccacgccccaggcu

SEQ ID NO: 541337 - RNA, 32 nt, Human
uuggauagcuaaauaucuuuguaagauagaga

SEQ ID NO: 541338 - RNA, 32 nt, Human
uuggauaggaaaggacuuagcacucaggccug

SEQ ID NO: 541339 - RNA, 32 nt, Human
uuggauaggaauagaagggaugaauucuaauu

SEQ ID NO: 541340 - RNA, 32 nt, Human
uuggauauccacuuacaguaagcuuuuuagua

SEQ ID NO: 541341 - RNA, 32 nt, Human
uuggauauccauccuccucgacuuauaguaca

SEQ ID NO: 541342 - RNA, 22 nt, Human
uuggauaucuuggcugcuguac

SEQ ID NO: 541343 - RNA, 32 nt, Human
uuggauaugaucuuucuuuucccaacauaugc

SEQ ID NO: 541344 - RNA, 32 nt, Human
uuggauauggccaggacccacagggacacagg

SEQ ID NO: 541345 - RNA, 32 nt, Human
uuggauauuucaucuggaguggacaaguacaa

SEQ ID NO: 541346 - RNA, 32 nt, Human
uuggaucaagacgauccaggagagcagcaacc

SEQ ID NO: 541347 - RNA, 32 nt, Human
uuggaucacaggaaguggaggagccagaggug

SEQ ID NO: 541348 - RNA, 32 nt, Human
uuggaucaccacaaccuccgucucccagguuc

SEQ ID NO: 541349 - RNA, 32 nt, Human
uuggaucacuacaaccuccaccucccggguuc

SEQ ID NO: 541350 - RNA, 32 nt, Human
uuggaucagcccagaggauucaggauaggaca

SEQ ID NO: 541351 - RNA, 32 nt, Human
uuggaucaggcaggguggcucacaccuguaau

SEQ ID NO: 541352 - RNA, 32 nt, Human
uuggaucagugacuaagaggcugcaauaaggu

SEQ ID NO: 541353 - RNA, 32 nt, Human
uuggaucauagcccuggccuggcggcacagca

SEQ ID NO: 541354 - RNA, 32 nt, Human
uuggauccaaggagguguaauggaaucggaau

SEQ ID NO: 541355 - RNA, 32 nt, Human
uuggauccucauucucacccauuuggcuaauc

SEQ ID NO: 541356 - RNA, 32 nt, Human
uuggaucgcuuugacuucuccaacacgguuug

SEQ ID NO: 541357 - RNA, 32 nt, Human
uuggaucuauccagagagaguagacuugacac

SEQ ID NO: 541358 - RNA, 32 nt, Human
uuggaucuccaauugccucuugcaggcugagu

SEQ ID NO: 541359 - RNA, 32 nt, Human
uuggaucuggaucauuuggaacagucuacaag

SEQ ID NO: 541360 - RNA, 32 nt, Human
uuggaucugugcugaaaaauugugacauuuca

SEQ ID NO: 541361 - RNA, 32 nt, Human
uuggaucuguucagagcugacccccuagcaac

SEQ ID NO: 541362 - RNA, 32 nt, Human
uuggaucuugaguucguuccacacagcaagau

SEQ ID NO: 541363 - RNA, 20 nt, Human
uuggaucuuucagggauuuu

SEQ ID NO: 541364 - RNA, 32 nt, Human
uuggaugaagaaacaaagaggagagaucagau

SEQ ID NO: 541365 - RNA, 32 nt, Human
uuggaugaaguggugcccucuccucugguccc

SEQ ID NO: 541366 - RNA, 21 nt, Human
uuggaugauaagagugaggug

SEQ ID NO: 541367 - RNA, 32 nt, Human
uuggaugaucagacugaauuuugucaaguauc

SEQ ID NO: 541368 - RNA, 32 nt, Human
uuggaugauggagccaaagaggggaugcuuug

SEQ ID NO: 541369 - RNA, 32 nt, Human
uuggaugauugugugacuauucauggcuaccu

SEQ ID NO: 541370 - RNA, 32 nt, Human
uuggaugccugggaacuuuuuguacccauugu

SEQ ID NO: 541371 - RNA, 32 nt, Human
uuggauggagucuagcucugucacccaggcug

SEQ ID NO: 541372 - RNA, 32 nt, Human
uuggauggcugaggcaggagaaucgcuugaac

SEQ ID NO: 541373 - RNA, 32 nt, Human
uuggauggggauguuacccuugcguucaacca

SEQ ID NO: 541374 - RNA, 32 nt, Human
uuggauggggccaagguggagcugcuagaaag

SEQ ID NO: 541375 - RNA, 32 nt, Human
uuggaugggguuucaccauguuagccaggaug

SEQ ID NO: 541376 - RNA, 32 nt, Human
uuggauguauuuuuaauuaaugggaccucagg

SEQ ID NO: 541377 - RNA, 32 nt, Human
uuggaugucaugugacccugugccucaguuuc

SEQ ID NO: 541378 - RNA, 32 nt, Human
uuggauguccagaauccccuguaguugauaau

SEQ ID NO: 541379 - RNA, 28 nt, Human
uuggaugugaguugaugacaaauguuaa

SEQ ID NO: 541380 - RNA, 32 nt, Human
uuggauguggucucuacacuaaccuucuugau

SEQ ID NO: 541381 - RNA, 32 nt, Human
uuggauguggugagcccaguuucugccaagaa

SEQ ID NO: 541382 - RNA, 32 nt, Human
uuggauguuuggcguugcacacacacauccac

SEQ ID NO: 541383 - RNA, 32 nt, Human
uuggauuaagucauaugccuccagccauuaua

SEQ ID NO: 541384 - RNA, 32 nt, Human
uuggauucccacgucaaaggaaaguuucaagc

SEQ ID NO: 541385 - RNA, 32 nt, Human
uuggauuccgucucccugcuccaugccuaccc

SEQ ID NO: 541386 - RNA, 32 nt, Human
uuggauucuacagaaagguucuguuggauucu

SEQ ID NO: 541387 - RNA, 32 nt, Human
uuggauucucauaagaagcacgcaaccuagau

SEQ ID NO: 541388 - RNA, 32 nt, Human
uuggauucugaguacagaacauguuauauugu

SEQ ID NO: 541389 - RNA, 32 nt, Human
uuggauugaaugaaaacagagagcuggggcuu

SEQ ID NO: 541390 - RNA, 32 nt, Human
uuggauugaugucuuuuauugguuucucaugg

SEQ ID NO: 541391 - RNA, 32 nt, Human
uuggauugcaugguuggacugagaucuauugg

SEQ ID NO: 541392 - RNA, 32 nt, Human
uuggauugcccucuuucaauuuccuugugaaa

SEQ ID NO: 541393 - RNA, 32 nt, Human
uuggauugcgaggcuagggcuuggggagucgu

SEQ ID NO: 541394 - RNA, 32 nt, Human
uuggauuggccaccaccccuccucacucucac

SEQ ID NO: 541395 - RNA, 32 nt, Human
uuggauuggucaucucaguauccggaguuacu

SEQ ID NO: 541396 - RNA, 32 nt, Human
uuggauugugccggcuaagaccugccagggag

SEQ ID NO: 541397 - RNA, 32 nt, Human
uuggauuugaccccuuggcucucaaguguccc

SEQ ID NO: 541398 - RNA, 32 nt, Human
uuggauuugaccuucaaaauugaaggucguuc

SEQ ID NO: 541399 - RNA, 32 nt, Human
uuggauuuggaaggcuugcaaugugguugacu

SEQ ID NO: 541400 - RNA, 32 nt, Human
uuggauuuugaauuuguauuucccucuaagug

SEQ ID NO: 541401 - RNA, 32 nt, Human
uuggauuuuguuguuugauggaauuugagcca

SEQ ID NO: 541402 - RNA, 32 nt, Human
uuggcaaaagaacagugucacacagauuccua

SEQ ID NO: 541403 - RNA, 32 nt, Human
uuggcaaacuccgcccuccacuuacuauuuug

SEQ ID NO: 541404 - RNA, 32 nt, Human
uuggcaacaacaaaaagccucuuucuugacuu

SEQ ID NO: 541405 - RNA, 32 nt, Human
uuggcaacacagugugagacccugucucaaaa

SEQ ID NO: 541406 - RNA, 32 nt, Human
uuggcaacauggugaaaccccaucuccaccaa

SEQ ID NO: 541407 - RNA, 32 nt, Human
uuggcaacccacacccuuccacacacgcucac

SEQ ID NO: 541408 - RNA, 32 nt, Human
uuggcaacucagcugcugcugcuuccaugugu

SEQ ID NO: 541409 - RNA, 22 nt, Human
uuggcaacuggucugcauguaa

SEQ ID NO: 541410 - RNA, 32 nt, Human
uuggcaagaaggcaggaguauguaugaggucc

SEQ ID NO: 541411 - RNA, 32 nt, Human
uuggcaagcgugccuugucggcuggguuaagc

SEQ ID NO: 541412 - RNA, 32 nt, Human
uuggcaagcuggauuucucagagccagcaugu

SEQ ID NO: 541413 - RNA, 32 nt, Human
uuggcaaggcccaagccuucuucaagaaggga

SEQ ID NO: 541414 - RNA, 32 nt, Human
uuggcaagugccugugcagggcccggccgccc

SEQ ID NO: 541415 - RNA, 32 nt, Human
uuggcaauccacuggucccuggacccggauaa

SEQ ID NO: 541416 - RNA, 32 nt, Human
uuggcaauugugaauaaugcugcaacaaauau

SEQ ID NO: 541417 - RNA, 32 nt, Human
uuggcacacaaaauauguaugcaguugcucca

SEQ ID NO: 541418 - RNA, 32 nt, Human
uuggcacacagugggagcucugagaacauggg

SEQ ID NO: 541419 - RNA, 32 nt, Human
uuggcacagaggacucuucugauaacuugaaa

SEQ ID NO: 541420 - RNA, 32 nt, Human
uuggcacagcagccggugucuccugcgcccgc

SEQ ID NO: 541421 - RNA, 32 nt, Human
uuggcaccagcucugagagcccuuccccugug

SEQ ID NO: 541422 - RNA, 32 nt, Human
uuggcaccaggagucccuguagccuggcuagg

SEQ ID NO: 541423 - RNA, 32 nt, Human
uuggcaccaucuuuauaugguugagucuccug

SEQ ID NO: 541424 - RNA, 32 nt, Human
uuggcaccucuguaggcccugccugugccugu

SEQ ID NO: 541425 - RNA, 32 nt, Human
uuggcaccuuacuucccugggauccccagagu

SEQ ID NO: 541426 - RNA, 32 nt, Human
uuggcaccuuguuaaaauuucuagucaucugu

SEQ ID NO: 541427 - RNA, 32 nt, Human
uuggcaccuuuaucaaauauuauuugacuaua

SEQ ID NO: 541428 - RNA, 32 nt, Human
uuggcacgaccuaccccgacacccaacaaagc

SEQ ID NO: 541429 - RNA, 32 nt, Human
uuggcacgcuauguucaggaacugaaacagga

SEQ ID NO: 541430 - RNA, 32 nt, Human
uuggcacgggauuucucagcuucgguggaaga

SEQ ID NO: 541431 - RNA, 32 nt, Human
uuggcacguguuguuuacauuuugcugugaca

SEQ ID NO: 541432 - RNA, 32 nt, Human
uuggcacuaagcuguuguauuaagcaugagag

SEQ ID NO: 541433 - RNA, 32 nt, Human
uuggcacuauuuauguuuuucaguuaaaaaca

SEQ ID NO: 541434 - RNA, 31 nt, Human
uuggcacucaauaaagauuugcagaauuuaa

SEQ ID NO: 541435 - RNA, 32 nt, Human
uuggcacuccacuccuauuuggagggacuuca

SEQ ID NO: 541436 - RNA, 32 nt, Human
uuggcacugaugcuguuuucucuugucugauu

SEQ ID NO: 541437 - RNA, 32 nt, Human
uuggcacugccauguaucucaggcuuggguuc

SEQ ID NO: 541438 - RNA, 32 nt, Human
uuggcacuuccaagcuggcaucuugccccuug

SEQ ID NO: 541439 - RNA, 32 nt, Human
uuggcagaagagugaaagaacuccugccaaga

SEQ ID NO: 541440 - RNA, 32 nt, Human
uuggcagacaggagugagaaagacuggggaag

SEQ ID NO: 541441 - RNA, 32 nt, Human
uuggcagacaguggcaaccucuggaagacaga

SEQ ID NO: 541442 - RNA, 32 nt, Human
uuggcagaggaagagcccuggcauuccagcag

SEQ ID NO: 541443 - RNA, 32 nt, Human
uuggcagaggcagagacauaagacgugcacga

SEQ ID NO: 541444 - RNA, 32 nt, Human
uuggcagaggcagggugucaacuugauuaggu

SEQ ID NO: 541445 - RNA, 32 nt, Human
uuggcagagggagaaauaagccagccacggca

SEQ ID NO: 541446 - RNA, 32 nt, Human
uuggcagauuuuguuggcauuauugaaauaua

SEQ ID NO: 541447 - RNA, 32 nt, Human
uuggcagcacagaacucagcucaaggguucug

SEQ ID NO: 541448 - RNA, 32 nt, Human
uuggcagcagcguccagugcccugccaguagc

SEQ ID NO: 541449 - RNA, 32 nt, Human
uuggcagcagcuaccugccagagauguugaag

SEQ ID NO: 541450 - RNA, 32 nt, Human
uuggcagcaggagcuguccuuuuguugggugc

SEQ ID NO: 541451 - RNA, 32 nt, Human
uuggcagcauucuccccaaaugccugggcacc

SEQ ID NO: 541452 - RNA, 32 nt, Human
uuggcagccaggccuggcucucagcagcucug

SEQ ID NO: 541453 - RNA, 32 nt, Human
uuggcagccauguuggaaaaaucucuuuuggc

SEQ ID NO: 541454 - RNA, 32 nt, Human
uuggcagcccacuccccagccccagccccuuc

SEQ ID NO: 541455 - RNA, 32 nt, Human
uuggcagcccuucacguagccuccugccucgc

SEQ ID NO: 541456 - RNA, 32 nt, Human
uuggcagccugagagcuccaaggaacaagcug

SEQ ID NO: 541457 - RNA, 32 nt, Human
uuggcagccugagcucuggagccagacuucug

SEQ ID NO: 541458 - RNA, 32 nt, Human
uuggcagcucacugaucucuugccucugcuga

SEQ ID NO: 541459 - RNA, 32 nt, Human
uuggcagcugaggaguggaggcugggcagcuc

SEQ ID NO: 541460 - RNA, 32 nt, Human
uuggcagcugccguacuccaggcuugugucgg

SEQ ID NO: 541461 - RNA, 31 nt, Human
uuggcagcugugccagaaaccaaagccaggc

SEQ ID NO: 541462 - RNA, 32 nt, Human
uuggcagcuguguugcugggccuggugcugcu

SEQ ID NO: 541463 - RNA, 32 nt, Human
uuggcaggacacagagagguaggugaacauuc

SEQ ID NO: 541464 - RNA, 21 nt, Human
uuggcaggacuuucugugcca

SEQ ID NO: 541465 - RNA, 32 nt, Human
uuggcaggccgaggcagguggaucaccugacg

SEQ ID NO: 541466 - RNA, 32 nt, Human
uuggcaggccgaggcggguggaucacuugagg

SEQ ID NO: 541467 - RNA, 32 nt, Human
uuggcaggcuaacgcaggagaaucacuugacc

SEQ ID NO: 541468 - RNA, 32 nt, Human
uuggcaggcucacuucugaggugcaaaacaua

SEQ ID NO: 541469 - RNA, 32 nt, Human
uuggcaggcugaagcaggagaauggcgugaac

SEQ ID NO: 541470 - RNA, 32 nt, Human
uuggcaggcugaggcagaagaaucaccugaac

SEQ ID NO: 541471 - RNA, 32 nt, Human
uuggcaggcugaggcaggagaauugcuugaac

SEQ ID NO: 541472 - RNA, 32 nt, Human
uuggcaggcugaggugggagaaucgcuugagc

SEQ ID NO: 541473 - RNA, 32 nt, Human
uuggcaggcuuaguaccaccugcuccucaucu

SEQ ID NO: 541474 - RNA, 32 nt, Human
uuggcagggagacagccuggcccagugacccu

SEQ ID NO: 541475 - RNA, 32 nt, Human
uuggcagggcaggcuuccuggaggaggggcug

SEQ ID NO: 541476 - RNA, 32 nt, Human
uuggcagggccuucaagaggccuguguggggg

SEQ ID NO: 541477 - RNA, 32 nt, Human
uuggcagggcuguccccucuugcuucuccuug

SEQ ID NO: 541478 - RNA, 28 nt, Human
uuggcagggguggcugccucauuuagag

SEQ ID NO: 541479 - RNA, 32 nt, Human
uuggcagguggcagcaggaugguggguguuca

SEQ ID NO: 541480 - RNA, 32 nt, Human
uuggcaggugugagaucgaggccaguagugug

SEQ ID NO: 541481 - RNA, 32 nt, Human
uuggcaggugugagccaucgcgcccggccaac

SEQ ID NO: 541482 - RNA, 32 nt, Human
uuggcaguacagauaacaaaauacacuuuacu

SEQ ID NO: 541483 - RNA, 32 nt, Human
uuggcaguccucccaaucccacaccuccuguu

SEQ ID NO: 541484 - RNA, 32 nt, Human
uuggcagucugcaaccuggaagaggucccuca

SEQ ID NO: 541485 - RNA, 32 nt, Human
uuggcagugggacagauccagggauaggcuac

SEQ ID NO: 541486 - RNA, 32 nt, Human
uuggcaguuguucucuugagcacuuugaauuu

SEQ ID NO: 541487 - RNA, 32 nt, Human
uuggcauagguauguguauacacacggugcac

SEQ ID NO: 541488 - RNA, 32 nt, Human
uuggcauagugauuuuuauuucugggugggau

SEQ ID NO: 541489 - RNA, 32 nt, Human
uuggcauauauacuuggcauuccuguccacca

SEQ ID NO: 541490 - RNA, 32 nt, Human
uuggcaucagucacagucuuccucagaggaac

SEQ ID NO: 541491 - RNA, 32 nt, Human
uuggcaucaucccagggacauccucaaauaca

SEQ ID NO: 541492 - RNA, 32 nt, Human
uuggcaucccaaagugcugggacuacaggccu

SEQ ID NO: 541493 - RNA, 32 nt, Human
uuggcaucccaaagugcugggauuacaagaau

SEQ ID NO: 541494 - RNA, 32 nt, Human
uuggcaucccaaagugcugggauuacagcauc

SEQ ID NO: 541495 - RNA, 32 nt, Human
uuggcaucccaaagugcugggauuacgagcgu

SEQ ID NO: 541496 - RNA, 32 nt, Human
uuggcaucccaaaguguugggauuauaggcac

SEQ ID NO: 541497 - RNA, 32 nt, Human
uuggcaucccuaauagacuggcucccaaggca

SEQ ID NO: 541498 - RNA, 32 nt, Human
uuggcaucccuuccugccguccuugacucuuu

SEQ ID NO: 541499 - RNA, 32 nt, Human
uuggcauccuaaagugcugggauuacaggcgu

SEQ ID NO: 541500 - RNA, 32 nt, Human
uuggcaucuaguccaaacaagacugaagaaug

SEQ ID NO: 541501 - RNA, 32 nt, Human
uuggcaucugcacuccagcccaggacuguggu

SEQ ID NO: 541502 - RNA, 32 nt, Human
uuggcaugagagaacuuggaagccggcuguca

SEQ ID NO: 541503 - RNA, 32 nt, Human
uuggcaugaggagagaaaggaaccugaaguuu

SEQ ID NO: 541504 - RNA, 32 nt, Human
uuggcaugcaucucucccagaggagaucucuc

SEQ ID NO: 541505 - RNA, 32 nt, Human
uuggcaugccauugaaacuaagagcucucaag

SEQ ID NO: 541506 - RNA, 32 nt, Human
uuggcaugcuggcaaaugcuacuccuugcuuu

SEQ ID NO: 541507 - RNA, 25 nt, Human
uuggcauggcugccuugauguaaca

SEQ ID NO: 541508 - RNA, 32 nt, Human
uuggcauucaguuguuaaaaacaaauaggaug

SEQ ID NO: 541509 - RNA, 32 nt, Human
uuggcauucauagauaaacagcucaggcauaa

SEQ ID NO: 541510 - RNA, 32 nt, Human
uuggcauugauuguaauucugccuuuuuggaa

SEQ ID NO: 541511 - RNA, 32 nt, Human
uuggcauugcaaccuccauuucuagcuccugu

SEQ ID NO: 541512 - RNA, 32 nt, Human
uuggcauuggcaccaguguggucaccugcccc

SEQ ID NO: 541513 - RNA, 32 nt, Human
uuggcauuguaccuggguacaggaagccuuug

SEQ ID NO: 541514 - RNA, 32 nt, Human
uuggcauuugaacaaaagacuuacuuacaaag

SEQ ID NO: 541515 - RNA, 32 nt, Human
uuggcauuugcaggucaagcaggaagcaguug

SEQ ID NO: 541516 - RNA, 32 nt, Human
uuggcauuugcaucacugccuucuguucccgg

SEQ ID NO: 541517 - RNA, 32 nt, Human
uuggcauuugcuuaguuggaaaaaggaacacu

SEQ ID NO: 541518 - RNA, 32 nt, Human
uuggccaaaguguugggauuacaggcauaagc

SEQ ID NO: 541519 - RNA, 32 nt, Human
uuggccaacauagugaaaccccaucucuacca

SEQ ID NO: 541520 - RNA, 32 nt, Human
uuggccaacauggagaaaccccaucucuacua

SEQ ID NO: 541521 - RNA, 32 nt, Human
uuggccaacauggcgaaaccccaucgcuacua

SEQ ID NO: 541522 - RNA, 32 nt, Human
uuggccaacauggcgaaaccccaucucuaccg

SEQ ID NO: 541523 - RNA, 32 nt, Human
uuggccaacauggugaaaccccaucuccacaa

SEQ ID NO: 541524 - RNA, 32 nt, Human
uuggccaacauggugaaaccccaucucuacca

SEQ ID NO: 541525 - RNA, 32 nt, Human
uuggccaacauggugaaacccugucucuccua

SEQ ID NO: 541526 - RNA, 32 nt, Human
uuggccaacauggugaaaccucaucucuacua

SEQ ID NO: 541527 - RNA, 32 nt, Human
uuggccaacauggugaaauccugucuguacua

SEQ ID NO: 541528 - RNA, 32 nt, Human
uuggccaacauggugaagcucugucucuacua

SEQ ID NO: 541529 - RNA, 32 nt, Human
uuggccaacauggugagaccccaucucugcua

SEQ ID NO: 541530 - RNA, 32 nt, Human
uuggccaacauggugagcccccgucucuacua

SEQ ID NO: 541531 - RNA, 32 nt, Human
uuggccaacugcacucuggaggcggcggcagc

SEQ ID NO: 541532 - RNA, 32 nt, Human
uuggccaagauggugaaaccccaucucuacua

SEQ ID NO: 541533 - RNA, 32 nt, Human
uuggccaagauggugaaaucccaucucuacaa

SEQ ID NO: 541534 - RNA, 32 nt, Human
uuggccaaguagcugugggcaggcaagcccuu

SEQ ID NO: 541535 - RNA, 20 nt, Human
uuggccacaauagagaugga

SEQ ID NO: 541536 - RNA, 24 nt, Human
uuggccacacaguggcacuggagu

SEQ ID NO: 541537 - RNA, 32 nt, Human
uuggccacagccaggggagcagaggggcagag

SEQ ID NO: 541538 - RNA, 32 nt, Human
uuggccacagcgugggaagcagcucuggggga

SEQ ID NO: 541539 - RNA, 32 nt, Human
uuggccacaguuacagggagagaacaauauca

SEQ ID NO: 541540 - RNA, 32 nt, Human
uuggccacccugcacguugugcacugaccuuu

SEQ ID NO: 541541 - RNA, 32 nt, Human
uuggccacccuugccauuucugcucccagagu

SEQ ID NO: 541542 - RNA, 22 nt, Human
uuggccaccucaugcccauccc

SEQ ID NO: 541543 - RNA, 32 nt, Human
uuggccaccuccaggaaguccaaaucaggauc

SEQ ID NO: 541544 - RNA, 32 nt, Human
uuggccacugcaagcuccaccucccagguuca

SEQ ID NO: 541545 - RNA, 32 nt, Human
uuggccagaaucugaggggagagcccccagag

SEQ ID NO: 541546 - RNA, 32 nt, Human
uuggccagagucaggggacagggagagagcuc

SEQ ID NO: 541547 - RNA, 32 nt, Human
uuggccagagucaggggacagggagggagcuc

SEQ ID NO: 541548 - RNA, 32 nt, Human
uuggccagagugguuugaugguuuuguguuag

SEQ ID NO: 541549 - RNA, 32 nt, Human
uuggccagcacuaguuaggggaggucaggugg

SEQ ID NO: 541550 - RNA, 32 nt, Human
uuggccagcccuggguggaggugggugcaagc

SEQ ID NO: 541551 - RNA, 32 nt, Human
uuggccagcgcuguugagggguccccucugga

SEQ ID NO: 541552 - RNA, 24 nt, Human
uuggccagcguagacagcagcaaa

SEQ ID NO: 541553 - RNA, 32 nt, Human
uuggccagcugguccccgcuacauucaaccaa

SEQ ID NO: 541554 - RNA, 20 nt, Human
uuggccagcuuuucugccag

SEQ ID NO: 541555 - RNA, 32 nt, Human
uuggccaggccucucagaauugagugagcgug

SEQ ID NO: 541556 - RNA, 32 nt, Human
uuggccaggcuggaaugcaguggcacaaucau

SEQ ID NO: 541557 - RNA, 21 nt, Human
uuggccaggcuggagugcagu

SEQ ID NO: 541558 - RNA, 32 nt, Human
uuggccaggcuggagugcaguaaguggcacaa

SEQ ID NO: 541559 - RNA, 32 nt, Human
uuggccaggcugggacucgaacuccugaccuu

SEQ ID NO: 541560 - RNA, 32 nt, Human
uuggccaggcuggucucaaccucuggaccuca

SEQ ID NO: 541561 - RNA, 32 nt, Human
uuggccaggcuggucucgaacuccugagcuca

SEQ ID NO: 541562 - RNA, 32 nt, Human
uuggccaggcuggucucgaacucuggaccuca

SEQ ID NO: 541563 - RNA, 32 nt, Human
uuggccaggcuggucucgaacucuggguucaa

SEQ ID NO: 541564 - RNA, 32 nt, Human
uuggccaggcuggucucgaacuucugaccuca

SEQ ID NO: 541565 - RNA, 32 nt, Human
uuggccaggcuggucucgaacuucugacguca

SEQ ID NO: 541566 - RNA, 32 nt, Human
uuggccaggcuggucucgaagccugagccaua

SEQ ID NO: 541567 - RNA, 32 nt, Human
uuggccaggcuggucucgaaugucugaccuca

SEQ ID NO: 541568 - RNA, 32 nt, Human
uuggccaggcuggucucgaauuccugagcuca

SEQ ID NO: 541569 - RNA, 32 nt, Human
uuggccaggcuggucucgaauuccuggccuca

SEQ ID NO: 541570 - RNA, 32 nt, Human
uuggccaggcuggucuggaacuccugagcuca

SEQ ID NO: 541571 - RNA, 32 nt, Human
uuggccaggcuggucuggaacuccuggccucc

SEQ ID NO: 541572 - RNA, 32 nt, Human
uuggccaggcuggucuuagacuccugaccuca

SEQ ID NO: 541573 - RNA, 32 nt, Human
uuggccaggcuggucuugaacucccagccuga

SEQ ID NO: 541574 - RNA, 32 nt, Human
uuggccaggcuggucuugaacuccugagccug

SEQ ID NO: 541575 - RNA, 32 nt, Human
uuggccaggcuggucuugaacuccugagcuca

SEQ ID NO: 541576 - RNA, 32 nt, Human
uuggccaggcuggucuugaacuucugaccuga

SEQ ID NO: 541577 - RNA, 32 nt, Human
uuggccaggcuggucuugaauuccucagcuca

SEQ ID NO: 541578 - RNA, 32 nt, Human
uuggccaggcuggucuugaauuccugaccuca

SEQ ID NO: 541579 - RNA, 32 nt, Human
uuggccaggcuggucuugaauuccugaccucg

SEQ ID NO: 541580 - RNA, 32 nt, Human
uuggccaggcuggucuugaauucuuggcccca

SEQ ID NO: 541581 - RNA, 32 nt, Human
uuggccaggcuggugugaucauggcucauugc

SEQ ID NO: 541582 - RNA, 32 nt, Human
uuggccagggaggcgcagagacauggggcaag

SEQ ID NO: 541583 - RNA, 32 nt, Human
uuggccagucaccaccaccauccuaugcagcu

SEQ ID NO: 541584 - RNA, 32 nt, Human
uuggccagucuguaggccaacaagaagguucc

SEQ ID NO: 541585 - RNA, 32 nt, Human
uuggccaguggcuguggaggggaccaccugcc

SEQ ID NO: 541586 - RNA, 32 nt, Human
uuggccaguguuuccaggaggcucugggcuuc

SEQ ID NO: 541587 - RNA, 32 nt, Human
uuggccaucuguaugcuagagaggggugagga

SEQ ID NO: 541588 - RNA, 32 nt, Human
uuggccaucuucucgcagagugcucccugcua

SEQ ID NO: 541589 - RNA, 32 nt, Human
uuggccaugcuggucucaaauucugaaagagg

SEQ ID NO: 541590 - RNA, 32 nt, Human
uuggccauggccaagaaaaaggaaaagaaaga

SEQ ID NO: 541591 - RNA, 32 nt, Human
uuggccauucuuuccccuccccuaccccuuuu

SEQ ID NO: 541592 - RNA, 32 nt, Human
uuggccauugcacuccagccugggugacagag

SEQ ID NO: 541593 - RNA, 32 nt, Human
uuggcccaaccacaggcuaaucccaggccaug

SEQ ID NO: 541594 - RNA, 32 nt, Human
uuggcccaacuggcuccaaccuaucuggucaa

SEQ ID NO: 541595 - RNA, 32 nt, Human
uuggcccaacuggggcccuccgcugcuucugg

SEQ ID NO: 541596 - RNA, 32 nt, Human
uuggcccaaggaugccuggggccugccagcug

SEQ ID NO: 541597 - RNA, 32 nt, Human
uuggcccacugcaaccucugccucccggguuc

SEQ ID NO: 541598 - RNA, 32 nt, Human
uuggcccacugcaagcuccgccucccagguuc

SEQ ID NO: 541599 - RNA, 32 nt, Human
uuggcccagcugaaaacggaauucuuugccgg

SEQ ID NO: 541600 - RNA, 32 nt, Human
uuggcccagcuuuuagaaaaugcagucauuuu

SEQ ID NO: 541601 - RNA, 31 nt, Human
uuggcccaggaaagagaaaagguuguauguu

SEQ ID NO: 541602 - RNA, 32 nt, Human
uuggcccaggaggcagagguugcagugagcug

SEQ ID NO: 541603 - RNA, 21 nt, Human
uuggcccaugcagucugcaug

SEQ ID NO: 541604 - RNA, 32 nt, Human
uuggccccagaggcgagggaccaguggaggug

SEQ ID NO: 541605 - RNA, 32 nt, Human
uuggccccagaggggcccucccaugggaagau

SEQ ID NO: 541606 - RNA, 32 nt, Human
uuggccccagggagggcaggaggcucuugacc

SEQ ID NO: 541607 - RNA, 20 nt, Human
uuggcccccacccccuccac

SEQ ID NO: 541608 - RNA, 18 nt, Human
uuggcccccagccccuuc

SEQ ID NO: 541609 - RNA, 23 nt, Human
uuggcccccagcugcgccugaca

SEQ ID NO: 541610 - RNA, 21 nt, Human
uuggcccccaugacccuucca

SEQ ID NO: 541611 - RNA, 22 nt, Human
uuggcccccuacagcagucugg

SEQ ID NO: 541612 - RNA, 32 nt, Human
uuggcccccucccucccuauaaggcuguggaa

SEQ ID NO: 541613 - RNA, 32 nt, Human
uuggcccccugcaaccuccgccucccggguuc

SEQ ID NO: 541614 - RNA, 32 nt, Human
uuggcccccugcccuccucucccucccagaug

SEQ ID NO: 541615 - RNA, 32 nt, Human
uuggccccucucacacagagcugucagcaggg

SEQ ID NO: 541616 - RNA, 32 nt, Human
uuggccccugcccagccgcucucccuguccuc

SEQ ID NO: 541617 - RNA, 17 nt, Human
uuggccccuggggccuu

SEQ ID NO: 541618 - RNA, 32 nt, Human
uuggccccuguggcuggccagauucugcccuu

SEQ ID NO: 541619 - RNA, 32 nt, Human
uuggcccgccugccuccacuccugccuucacc

SEQ ID NO: 541620 - RNA, 32 nt, Human
uuggcccuagaagagaaaguugaagaguccca

SEQ ID NO: 541621 - RNA, 32 nt, Human
uuggcccuccaggcauccccaguuuccagccu

SEQ ID NO: 541622 - RNA, 32 nt, Human
uuggcccucucucugaccucagggccuggcca

SEQ ID NO: 541623 - RNA, 32 nt, Human
uuggcccugaguggccagggaggucaacuuga

SEQ ID NO: 541624 - RNA, 32 nt, Human
uuggcccugagugucuugagacagugggccau

SEQ ID NO: 541625 - RNA, 32 nt, Human
uuggcccugcagcaugucaugcucccagaauu

SEQ ID NO: 541626 - RNA, 32 nt, Human
uuggcccugcagccuccaccucgccgcugggg

SEQ ID NO: 541627 - RNA, 32 nt, Human
uuggcccugccugaugccaagcaaagacccuu

SEQ ID NO: 541628 - RNA, 32 nt, Human
uuggcccugccuggcccagccugcaccccugu

SEQ ID NO: 541629 - RNA, 32 nt, Human
uuggcccugcuauuuauuuuuguauuuauguc

SEQ ID NO: 541630 - RNA, 32 nt, Human
uuggcccuggucccgucugccugcuccucagg

SEQ ID NO: 541631 - RNA, 18 nt, Human
uuggcccuucuccaccca

SEQ ID NO: 541632 - RNA, 32 nt, Human
uuggcccuuuggcucuugcccuuggcucccuu

SEQ ID NO: 541633 - RNA, 32 nt, Human
uuggcccuuuucucacccucuggaguucccac

SEQ ID NO: 541634 - RNA, 31 nt, Human
uuggccgacaacacagagaggagggggagcu

SEQ ID NO: 541635 - RNA, 32 nt, Human
uuggccgacacagauauuccagugcauguggu

SEQ ID NO: 541636 - RNA, 32 nt, Human
uuggccgaugaaguaccugcucagcuuagcua

SEQ ID NO: 541637 - RNA, 32 nt, Human
uuggccgcccacuugauccagaccguacugag

SEQ ID NO: 541638 - RNA, 19 nt, Human
uuggccgccccccucccag

SEQ ID NO: 541639 - RNA, 20 nt, Human
uuggccgccccccucccagg

SEQ ID NO: 541640 - RNA, 32 nt, Human
uuggccgcgacucucugcuucucuccagcucu

SEQ ID NO: 541641 - RNA, 32 nt, Human
uuggccggauguccucagggcuggcagaugca

SEQ ID NO: 541642 - RNA, 32 nt, Human
uuggccggcuaguguuuccucucauuucccuu

SEQ ID NO: 541643 - RNA, 32 nt, Human
uuggccgggccuggccagcagugcacagugcc

SEQ ID NO: 541644 - RNA, 32 nt, Human
uuggccgggcugggcaggugcgccuuccuuuc

SEQ ID NO: 541645 - RNA, 32 nt, Human
uuggccggucuuggcgcugucaccucuuuugg

SEQ ID NO: 541646 - RNA, 32 nt, Human
uuggccgucucaucuugccacuuccaggaggc

SEQ ID NO: 541647 - RNA, 32 nt, Human
uuggccgugcucauggcgcccuccuccugggg

SEQ ID NO: 541648 - RNA, 32 nt, Human
uuggccuaaaaauuaaaagagaucgauauuaa

SEQ ID NO: 541649 - RNA, 32 nt, Human
uuggccuaccugggccagcccccaccaccugg

SEQ ID NO: 541650 - RNA, 32 nt, Human
uuggccuacuuacaaguagugaaaguucccuu

SEQ ID NO: 541651 - RNA, 32 nt, Human
uuggccuagcaugggagccaccacgggaacac

SEQ ID NO: 541652 - RNA, 32 nt, Human
uuggccuaggaguucaagaccagccugggcua

SEQ ID NO: 541653 - RNA, 23 nt, Human
uuggccuauacgguuuucagcua

SEQ ID NO: 541654 - RNA, 32 nt, Human
uuggccuaugaccagucugauugguugcagga

SEQ ID NO: 541655 - RNA, 32 nt, Human
uuggccuaugaucccgugugggccacugguac

SEQ ID NO: 541656 - RNA, 32 nt, Human
uuggccucaaaguauugagauuacaggcauga

SEQ ID NO: 541657 - RNA, 32 nt, Human
uuggccucaaauuaucugcccaccucggccuc

SEQ ID NO: 541658 - RNA, 32 nt, Human
uuggccucaaauucaguuuauuuggugaaaag

SEQ ID NO: 541659 - RNA, 32 nt, Human
uuggccucaagcaauccuccuccagagccucc

SEQ ID NO: 541660 - RNA, 32 nt, Human
uuggccucaagcaauccuuccucuuuggccuc

SEQ ID NO: 541661 - RNA, 32 nt, Human
uuggccucaagggauccucccaccucggcuuc

SEQ ID NO: 541662 - RNA, 32 nt, Human
uuggccucaaguaauccuccugccucagccuc

SEQ ID NO: 541663 - RNA, 32 nt, Human
uuggccucacaaagugcugggauuauaggcaa

SEQ ID NO: 541664 - RNA, 32 nt, Human
uuggccucaggaaaucaaccaaugcugcggaa

SEQ ID NO: 541665 - RNA, 32 nt, Human
uuggccucaggagcugggggugcaguggggga

SEQ ID NO: 541666 - RNA, 32 nt, Human
uuggccuccaaaagugcugggauuacaggcau

SEQ ID NO: 541667 - RNA, 32 nt, Human
uuggccuccacaagugcugggauuacaggugu

SEQ ID NO: 541668 - RNA, 32 nt, Human
uuggccucccaaaauacugggauuacaggggu

SEQ ID NO: 541669 - RNA, 32 nt, Human
uuggccucccaaaauauugggauuacagacau

SEQ ID NO: 541670 - RNA, 32 nt, Human
uuggccucccaaaaugcugagauuacaggugu

SEQ ID NO: 541671 - RNA, 32 nt, Human
uuggccucccaaaaugcugggauuacaggcau

SEQ ID NO: 541672 - RNA, 32 nt, Human
uuggccucccaaaaugcugggauuacaggcgu

SEQ ID NO: 541673 - RNA, 32 nt, Human
uuggccucccaaaaugcugggauuacaggugu

SEQ ID NO: 541674 - RNA, 32 nt, Human
uuggccucccaaaaugcugggauuauaggcau

SEQ ID NO: 541675 - RNA, 32 nt, Human
uuggccucccaaaaugcugggguuacaggcau

SEQ ID NO: 541676 - RNA, 32 nt, Human
uuggccucccaaaauguugggauuacagaugg

SEQ ID NO: 541677 - RNA, 32 nt, Human
uuggccucccaaaauucugggauuacaggcau

SEQ ID NO: 541678 - RNA, 32 nt, Human
uuggccucccaaacugcuggcauuacaggugu

SEQ ID NO: 541679 - RNA, 32 nt, Human
uuggccucccaaacugcugggauuacaggcgu

SEQ ID NO: 541680 - RNA, 32 nt, Human
uuggccucccaaagagcugggauuacaggcau

SEQ ID NO: 541681 - RNA, 32 nt, Human
uuggccucccaaagcacugggauuacaagcau

SEQ ID NO: 541682 - RNA, 32 nt, Human
uuggccucccaaagcacugggauuacaggcau

SEQ ID NO: 541683 - RNA, 32 nt, Human
uuggccucccaaagcgcuaggauuacagaugu

SEQ ID NO: 541684 - RNA, 32 nt, Human
uuggccucccaaagcgcugggauuacaggcau

SEQ ID NO: 541685 - RNA, 32 nt, Human
uuggccucccaaagcgcugggauuacaggugu

SEQ ID NO: 541686 - RNA, 32 nt, Human
uuggccucccaaagcgcugggauuauaggcgu

SEQ ID NO: 541687 - RNA, 32 nt, Human
uuggccucccaaagcgcugggauuauaggucu

SEQ ID NO: 541688 - RNA, 32 nt, Human
uuggccucccaaagcgcugguauuacaggugu

SEQ ID NO: 541689 - RNA, 32 nt, Human
uuggccucccaaagcguugggauuauaggcau

SEQ ID NO: 541690 - RNA, 32 nt, Human
uuggccucccaaagggcugugauuacaggcgu

SEQ ID NO: 541691 - RNA, 32 nt, Human
uuggccucccaaaggguugggauuacaggugu

SEQ ID NO: 541692 - RNA, 32 nt, Human
uuggccucccaaaguacugggauuacaggcau

SEQ ID NO: 541693 - RNA, 32 nt, Human
uuggccucccaaaguacugggauuacaggcgu

SEQ ID NO: 541694 - RNA, 32 nt, Human
uuggccucccaaagugaugggauuacagaugu

SEQ ID NO: 541695 - RNA, 32 nt, Human
uuggccucccaaagugccaggauuacaggcau

SEQ ID NO: 541696 - RNA, 32 nt, Human
uuggccucccaaagugccgggauuacaggcau

SEQ ID NO: 541697 - RNA, 32 nt, Human
uuggccucccaaagugcgggauuacaagcgug

SEQ ID NO: 541698 - RNA, 32 nt, Human
uuggccucccaaagugcuaagauuacaggcau

SEQ ID NO: 541699 - RNA, 32 nt, Human
uuggccucccaaagugcuagauuacaggcgug

SEQ ID NO: 541700 - RNA, 32 nt, Human
uuggccucccaaagugcuaggauuacagaugg

SEQ ID NO: 541701 - RNA, 32 nt, Human
uuggccucccaaagugcuaggauuacaggcau

SEQ ID NO: 541702 - RNA, 32 nt, Human
uuggccucccaaagugcuaggauuacaggcug

SEQ ID NO: 541703 - RNA, 32 nt, Human
uuggccucccaaagugcuaggauuacagguau

SEQ ID NO: 541704 - RNA, 32 nt, Human
uuggccucccaaagugcuaggauuacaggugu

SEQ ID NO: 541705 - RNA, 32 nt, Human
uuggccucccaaagugcugagauuacagaugu

SEQ ID NO: 541706 - RNA, 32 nt, Human
uuggccucccaaagugcugagauuacaggcau

SEQ ID NO: 541707 - RNA, 32 nt, Human
uuggccucccaaagugcugagauuacaggcgu

SEQ ID NO: 541708 - RNA, 32 nt, Human
uuggccucccaaagugcugagauuacaggugu

SEQ ID NO: 541709 - RNA, 32 nt, Human
uuggccucccaaagugcugagauuauaggcau

SEQ ID NO: 541710 - RNA, 32 nt, Human
uuggccucccaaagugcugagauugcagaugu

SEQ ID NO: 541711 - RNA, 32 nt, Human
uuggccucccaaagugcugcgauuacaggcgu

SEQ ID NO: 541712 - RNA, 32 nt, Human
uuggccucccaaagugcuggaauuacaggcau

SEQ ID NO: 541713 - RNA, 32 nt, Human
uuggccucccaaagugcuggaauugcagacgu

SEQ ID NO: 541714 - RNA, 32 nt, Human
uuggccucccaaagugcuggauuacaggcaua

SEQ ID NO: 541715 - RNA, 32 nt, Human
uuggccucccaaagugcuggcauuacaggcgu

SEQ ID NO: 541716 - RNA, 32 nt, Human
uuggccucccaaagugcuggcauuacagguau

SEQ ID NO: 541717 - RNA, 32 nt, Human
uuggccucccaaagugcuggcauuacaggugu

SEQ ID NO: 541718 - RNA, 32 nt, Human
uuggccucccaaagugcugggacgugacagga

SEQ ID NO: 541719 - RNA, 32 nt, Human
uuggccucccaaagugcugggacuacaggugc

SEQ ID NO: 541720 - RNA, 32 nt, Human
uuggccucccaaagugcugggagccacugcuc

SEQ ID NO: 541721 - RNA, 32 nt, Human
uuggccucccaaagugcugggaucacaggcau

SEQ ID NO: 541722 - RNA, 32 nt, Human
uuggccucccaaagugcugggaucacaggcgu

SEQ ID NO: 541723 - RNA, 32 nt, Human
uuggccucccaaagugcugggauuacaagcgu

SEQ ID NO: 541724 - RNA, 32 nt, Human
uuggccucccaaagugcugggauuacagacau

SEQ ID NO: 541725 - RNA, 32 nt, Human
uuggccucccaaagugcugggauuacagacgu

SEQ ID NO: 541726 - RNA, 32 nt, Human
uuggccucccaaagugcugggauuacagaugu

SEQ ID NO: 541727 - RNA, 32 nt, Human
uuggccucccaaagugcugggauuacagccac

SEQ ID NO: 541728 - RNA, 32 nt, Human
uuggccucccaaagugcugggauuacagccgu

SEQ ID NO: 541729 - RNA, 32 nt, Human
uuggccucccaaagugcugggauuacagcugu

SEQ ID NO: 541730 - RNA, 32 nt, Human
uuggccucccaaagugcugggauuacaggagu

SEQ ID NO: 541731 - RNA, 32 nt, Human
uuggccucccaaagugcugggauuacaggcau

SEQ ID NO: 541732 - RNA, 32 nt, Human
uuggccucccaaagugcugggauuacaggccu

SEQ ID NO: 541733 - RNA, 32 nt, Human
uuggccucccaaagugcugggauuacaggcgc

SEQ ID NO: 541734 - RNA, 32 nt, Human
uuggccucccaaagugcugggauuacaggcgg

SEQ ID NO: 541735 - RNA, 32 nt, Human
uuggccucccaaagugcugggauuacaggcgu

SEQ ID NO: 541736 - RNA, 32 nt, Human
uuggccucccaaagugcugggauuacagggau

SEQ ID NO: 541737 - RNA, 32 nt, Human
uuggccucccaaagugcugggauuacagggca

SEQ ID NO: 541738 - RNA, 32 nt, Human
uuggccucccaaagugcugggauuacagggga

SEQ ID NO: 541739 - RNA, 32 nt, Human
uuggccucccaaagugcugggauuacagguac

SEQ ID NO: 541740 - RNA, 32 nt, Human
uuggccucccaaagugcugggauuacaggugu

SEQ ID NO: 541741 - RNA, 32 nt, Human
uuggccucccaaagugcugggauuaccagcau

SEQ ID NO: 541742 - RNA, 32 nt, Human
uuggccucccaaagugcugggauuacgggcau

SEQ ID NO: 541743 - RNA, 32 nt, Human
uuggccucccaaagugcugggauuacuggcau

SEQ ID NO: 541744 - RNA, 32 nt, Human
uuggccucccaaagugcugggauuacugguau

SEQ ID NO: 541745 - RNA, 32 nt, Human
uuggccucccaaagugcugggauuagaagcgu

SEQ ID NO: 541746 - RNA, 32 nt, Human
uuggccucccaaagugcugggauuagaggcau

SEQ ID NO: 541747 - RNA, 32 nt, Human
uuggccucccaaagugcugggauuagaggcgu

SEQ ID NO: 541748 - RNA, 32 nt, Human
uuggccucccaaagugcugggauuauaggagu

SEQ ID NO: 541749 - RNA, 32 nt, Human
uuggccucccaaagugcugggauuauaggcac

SEQ ID NO: 541750 - RNA, 32 nt, Human
uuggccucccaaagugcugggauuauaggcau

SEQ ID NO: 541751 - RNA, 32 nt, Human
uuggccucccaaagugcugggauuauaggcgu

SEQ ID NO: 541752 - RNA, 32 nt, Human
uuggccucccaaagugcugggauuauaggugu

SEQ ID NO: 541753 - RNA, 32 nt, Human
uuggccucccaaagugcugggauuaucaauau

SEQ ID NO: 541754 - RNA, 32 nt, Human
uuggccucccaaagugcugggauuauggacgu

SEQ ID NO: 541755 - RNA, 32 nt, Human
uuggccucccaaagugcugggauuccaggcgu

SEQ ID NO: 541756 - RNA, 32 nt, Human
uuggccucccaaagugcugggauucccggcgu

SEQ ID NO: 541757 - RNA, 32 nt, Human
uuggccucccaaagugcugggauugcagccgu

SEQ ID NO: 541758 - RNA, 32 nt, Human
uuggccucccaaagugcugggauugcaggugu

SEQ ID NO: 541759 - RNA, 32 nt, Human
uuggccucccaaagugcugggauuucaggcgu

SEQ ID NO: 541760 - RNA, 32 nt, Human
uuggccucccaaagugcugggguuaugggugu

SEQ ID NO: 541761 - RNA, 32 nt, Human
uuggccucccaaagugcuggguuacaagcgug

SEQ ID NO: 541762 - RNA, 32 nt, Human
uuggccucccaaagugcugugauuacaggugu

SEQ ID NO: 541763 - RNA, 32 nt, Human
uuggccucccaaaguguuaggauuacaggcau

SEQ ID NO: 541764 - RNA, 32 nt, Human
uuggccucccaaaguguuaggauuacaggcgu

SEQ ID NO: 541765 - RNA, 32 nt, Human
uuggccucccaaaguguuggauuacaggugug

SEQ ID NO: 541766 - RNA, 32 nt, Human
uuggccucccaaaguguugggauuacaggcaa

SEQ ID NO: 541767 - RNA, 32 nt, Human
uuggccucccaaaguguugggauuacaggcau

SEQ ID NO: 541768 - RNA, 32 nt, Human
uuggccucccaaaguguugggauuacaggcgu

SEQ ID NO: 541769 - RNA, 32 nt, Human
uuggccucccaaaguguugggauuacaugcau

SEQ ID NO: 541770 - RNA, 32 nt, Human
uuggccucccaaaguguugggauuauaggcau

SEQ ID NO: 541771 - RNA, 32 nt, Human
uuggccucccaaaguguugggauuauaggcgu

SEQ ID NO: 541772 - RNA, 32 nt, Human
uuggccucccaaaguucugggauuacaggcgu

SEQ ID NO: 541773 - RNA, 32 nt, Human
uuggccucccaaaguucugggauuacagguau

SEQ ID NO: 541774 - RNA, 32 nt, Human
uuggccucccaaaguucugggauuacauuuuu

SEQ ID NO: 541775 - RNA, 32 nt, Human
uuggccucccaaaguuuugggauuacaagugu

SEQ ID NO: 541776 - RNA, 32 nt, Human
uuggccucccaaaugcugggauuacagacaug

SEQ ID NO: 541777 - RNA, 32 nt, Human
uuggccucccaaauugcugggauuacaggugu

SEQ ID NO: 541778 - RNA, 32 nt, Human
uuggccucccaaauuguugggauuauaggcgu

SEQ ID NO: 541779 - RNA, 32 nt, Human
uuggccucccaacaugcugggauuacaggcgu

SEQ ID NO: 541780 - RNA, 32 nt, Human
uuggccucccaacauguugggauuacagaugg

SEQ ID NO: 541781 - RNA, 32 nt, Human
uuggccucccaacgugcugggauuauaggcgu

SEQ ID NO: 541782 - RNA, 32 nt, Human
uuggccucccaacuuguugggauuacagaugg

SEQ ID NO: 541783 - RNA, 32 nt, Human
uuggccucccaaggugcugggacuacaggcgu

SEQ ID NO: 541784 - RNA, 32 nt, Human
uuggccucccaaggugcugggauuacaggcau

SEQ ID NO: 541785 - RNA, 32 nt, Human
uuggccucccaaguagcugggauuacaggugu

SEQ ID NO: 541786 - RNA, 32 nt, Human
uuggccucccaaguugcugggauuacugacac

SEQ ID NO: 541787 - RNA, 32 nt, Human
uuggccucccacagugcugggauuacaggagu

SEQ ID NO: 541788 - RNA, 32 nt, Human
uuggccucccagaguauugggauuacagacau

SEQ ID NO: 541789 - RNA, 32 nt, Human
uuggccucccagagugcugggauuacaggcgu

SEQ ID NO: 541790 - RNA, 32 nt, Human
uuggccucccagagugcugggauuacaggggg

SEQ ID NO: 541791 - RNA, 32 nt, Human
uuggccucccagagugcugggauuacaggugu

SEQ ID NO: 541792 - RNA, 32 nt, Human
uuggccucccagagugcugggauuagucguca

SEQ ID NO: 541793 - RNA, 32 nt, Human
uuggccucccagauugcuggguuuacaggcau

SEQ ID NO: 541794 - RNA, 32 nt, Human
uuggccucccaggacaucuggccugaggggau

SEQ ID NO: 541795 - RNA, 32 nt, Human
uuggccucccauagugcugggauuacaggcau

SEQ ID NO: 541796 - RNA, 32 nt, Human
uuggccucccgaagugcugggauuacagaagu

SEQ ID NO: 541797 - RNA, 32 nt, Human
uuggccucccgaagugcugggauuacaggcau

SEQ ID NO: 541798 - RNA, 32 nt, Human
uuggccucccgaagugcugggauuacaggcgu

SEQ ID NO: 541799 - RNA, 32 nt, Human
uuggccucccgaagugcugggauugcaggcau

SEQ ID NO: 541800 - RNA, 32 nt, Human
uuggccuccgaaagugcugggauuacaggcgu

SEQ ID NO: 541801 - RNA, 32 nt, Human
uuggccuccuaaagugcugggauaacaggcgu

SEQ ID NO: 541802 - RNA, 32 nt, Human
uuggccuccuaaagugcugggaucacaggcgu

SEQ ID NO: 541803 - RNA, 32 nt, Human
uuggccuccuaaagugcugggauuacaggcgu

SEQ ID NO: 541804 - RNA, 32 nt, Human
uuggccuccuaaagugcugggauuacaugagc

SEQ ID NO: 541805 - RNA, 32 nt, Human
uuggccuccuagagugcugggauuacaggugu

SEQ ID NO: 541806 - RNA, 32 nt, Human
uuggccuccuagggugcugggauugcaggccu

SEQ ID NO: 541807 - RNA, 32 nt, Human
uuggccuccugaagugcugggauuacaggcau

SEQ ID NO: 541808 - RNA, 32 nt, Human
uuggccuccuggcugcuuucuccccuuccccc

SEQ ID NO: 541809 - RNA, 32 nt, Human
uuggccuccuuggggaggauggggagguagcc

SEQ ID NO: 541810 - RNA, 32 nt, Human
uuggccucgcagaaaacucucggauggcaaca

SEQ ID NO: 541811 - RNA, 32 nt, Human
uuggccucucaaagugcugggauuacaggcgu

SEQ ID NO: 541812 - RNA, 32 nt, Human
uuggccucucaaagugcugggauuacaggugu

SEQ ID NO: 541813 - RNA, 32 nt, Human
uuggccucucaaagugcugggauuacgggcgu

SEQ ID NO: 541814 - RNA, 32 nt, Human
uuggccucucaaagugcugggauuauaggcau

SEQ ID NO: 541815 - RNA, 32 nt, Human
uuggccucucccaggcuccucuucugcagugc

SEQ ID NO: 541816 - RNA, 32 nt, Human
uuggccucucgaagugcugggauuccaggcgu

SEQ ID NO: 541817 - RNA, 32 nt, Human
uuggccucucuaaaugcugggauugcaggcgu

SEQ ID NO: 541818 - RNA, 32 nt, Human
uuggccucucugagggucucucugugcaucuu

SEQ ID NO: 541819 - RNA, 32 nt, Human
uuggccucugcugccucucagucaccaaguca

SEQ ID NO: 541820 - RNA, 32 nt, Human
uuggccucuguggaucuguaucaguuccaaaa

SEQ ID NO: 541821 - RNA, 32 nt, Human
uuggccucuuccucaccaucuacaacagcaga

SEQ ID NO: 541822 - RNA, 32 nt, Human
uuggccugacaacagucuucugcccaugucug

SEQ ID NO: 541823 - RNA, 32 nt, Human
uuggccugacccauccccuugugagaccucac

SEQ ID NO: 541824 - RNA, 32 nt, Human
uuggccugagccaccagauuaugauguugcca

SEQ ID NO: 541825 - RNA, 31 nt, Human
uuggccugagccucucucccugugucucugu

SEQ ID NO: 541826 - RNA, 32 nt, Human
uuggccugcaaacacauuuacuucuccucuua

SEQ ID NO: 541827 - RNA, 32 nt, Human
uuggccugcaggcaaaugcuguaccuucaguu

SEQ ID NO: 541828 - RNA, 32 nt, Human
uuggccugccuggcuggggaggucaguaaacu

SEQ ID NO: 541829 - RNA, 32 nt, Human
uuggccugcuccaguguuuccuucagagagaa

SEQ ID NO: 541830 - RNA, 32 nt, Human
uuggccuggaggugggguugggauugggggcu

SEQ ID NO: 541831 - RNA, 32 nt, Human
uuggccugggagguccaggcugcaaugagcca

SEQ ID NO: 541832 - RNA, 32 nt, Human
uuggccugggaguuuccugcagccaggccagc

SEQ ID NO: 541833 - RNA, 22 nt, Human
uuggccugggugguagaggaga

SEQ ID NO: 541834 - RNA, 20 nt, Human
uuggccugucaacccaccca

SEQ ID NO: 541835 - RNA, 32 nt, Human
uuggccugugaacagcuggcccagaggaaggg

SEQ ID NO: 541836 - RNA, 32 nt, Human
uuggccuguuccaccaagugagagaagguacu

SEQ ID NO: 541837 - RNA, 32 nt, Human
uuggccuuaaggguaaaaaguacaauauacac

SEQ ID NO: 541838 - RNA, 32 nt, Human
uuggccuuaccaaagcaaaagagggugcaaga

SEQ ID NO: 541839 - RNA, 32 nt, Human
uuggccuuccaaaaugcugcgauuauauaggc

SEQ ID NO: 541840 - RNA, 32 nt, Human
uuggccuuccaaagugcugggauuacaggcau

SEQ ID NO: 541841 - RNA, 32 nt, Human
uuggccuuccaaagugcugggauuacaggcgu

SEQ ID NO: 541842 - RNA, 32 nt, Human
uuggccuuccaaagugcugggauuacaggugu

SEQ ID NO: 541843 - RNA, 32 nt, Human
uuggccuuccaaaguguugggauuacaggcau

SEQ ID NO: 541844 - RNA, 32 nt, Human
uuggccuuccaaaguguugggauuacaggcgu

SEQ ID NO: 541845 - RNA, 32 nt, Human
uuggccuuccaaaguguugggauuaugggcgu

SEQ ID NO: 541846 - RNA, 32 nt, Human
uuggccuuccaaaucacugggauuauaggcau

SEQ ID NO: 541847 - RNA, 32 nt, Human
uuggccuuccagagugcugggauuacaggcgu

SEQ ID NO: 541848 - RNA, 32 nt, Human
uuggccuuccucuccuucccucccucuuccuc

SEQ ID NO: 541849 - RNA, 32 nt, Human
uuggccuuccuugaccacuccauuuaauucuc

SEQ ID NO: 541850 - RNA, 32 nt, Human
uuggccuucuaaagugcugggauuacaggcgu

SEQ ID NO: 541851 - RNA, 32 nt, Human
uuggccuucucgggacuguccugucaccccuc

SEQ ID NO: 541852 - RNA, 25 nt, Human
uuggccuugccuccccuuccugcca

SEQ ID NO: 541853 - RNA, 32 nt, Human
uuggccuugggaauaguuggcugccaaucucc

SEQ ID NO: 541854 - RNA, 32 nt, Human
uuggccuugguugggcucugccaaagacuaau

SEQ ID NO: 541855 - RNA, 32 nt, Human
uuggccuuguaaaauacaacucucauuuaaua

SEQ ID NO: 541856 - RNA, 32 nt, Human
uuggccuuucaaagugcugggauuacaggcau

SEQ ID NO: 541857 - RNA, 32 nt, Human
uuggccuuuucagcuuucuucuugcccagcuc

SEQ ID NO: 541858 - RNA, 25 nt, Human
uuggcgacgggucuugcaugugaca

SEQ ID NO: 541859 - RNA, 32 nt, Human
uuggcgcaauccauguagcagugacccaggcu

SEQ ID NO: 541860 - RNA, 32 nt, Human
uuggcgcagcccugaagaaacuaccuaggaga

SEQ ID NO: 541861 - RNA, 32 nt, Human
uuggcgcauagaggagagaaggaaaccugagg

SEQ ID NO: 541862 - RNA, 32 nt, Human
uuggcgcauucccacacuccagucuggaucca

SEQ ID NO: 541863 - RNA, 32 nt, Human
uuggcgccaagacugcaucuagaaucgcucaa

SEQ ID NO: 541864 - RNA, 23 nt, Human
uuggcgccacagucacuuuucca

SEQ ID NO: 541865 - RNA, 32 nt, Human
uuggcgccccaugggcccucagcgucucccca

SEQ ID NO: 541866 - RNA, 18 nt, Human
uuggcgccuccuaccucc

SEQ ID NO: 541867 - RNA, 32 nt, Human
uuggcgccuguaaucccagcuacucgggaggc

SEQ ID NO: 541868 - RNA, 32 nt, Human
uuggcgcgaacuuguuugauauuugaaguguc

SEQ ID NO: 541869 - RNA, 32 nt, Human
uuggcgcucucucuuuucugcaugucaaguuc

SEQ ID NO: 541870 - RNA, 32 nt, Human
uuggcgcugccacgucugggccgcgguuccca

SEQ ID NO: 541871 - RNA, 20 nt, Human
uuggcgcugccugggguccu

SEQ ID NO: 541872 - RNA, 32 nt, Human
uuggcgcugucucucccccucggcucggagag

SEQ ID NO: 541873 - RNA, 32 nt, Human
uuggcgcuugccaacugggaaguauuuaggga

SEQ ID NO: 541874 - RNA, 32 nt, Human
uuggcggagacaggguuucaccauguuggcca

SEQ ID NO: 541875 - RNA, 32 nt, Human
uuggcggagcauggcccaggaggaggguggga

SEQ ID NO: 541876 - RNA, 32 nt, Human
uuggcggagggugguuuggaagaauggcgagg

SEQ ID NO: 541877 - RNA, 32 nt, Human
uuggcggcagcuggccccagacuucugucuuu

SEQ ID NO: 541878 - RNA, 23 nt, Human
uuggcggcuuagaucuccaaaug

SEQ ID NO: 541879 - RNA, 32 nt, Human
uuggcgggaagagaccaagggugcggcggcuc

SEQ ID NO: 541880 - RNA, 32 nt, Human
uuggcgggagacgggaaggcagcgggcugcgu

SEQ ID NO: 541881 - RNA, 32 nt, Human
uuggcgggguuuccucaucuccccagccugaa

SEQ ID NO: 541882 - RNA, 18 nt, Human
uuggcggguggggugcag

SEQ ID NO: 541883 - RNA, 32 nt, Human
uuggcggguggggugcagggagggagaggcag

SEQ ID NO: 541884 - RNA, 21 nt, Human
uuggcguacuucuggggccuu

SEQ ID NO: 541885 - RNA, 32 nt, Human
uuggcgucagaaguccuuaccucuuuauauug

SEQ ID NO: 541886 - RNA, 32 nt, Human
uuggcgucgggugggaggggaaaacgcaucuu

SEQ ID NO: 541887 - RNA, 32 nt, Human
uuggcgucuccgcugcuuuaccaggaaggaug

SEQ ID NO: 541888 - RNA, 32 nt, Human
uuggcgucuuccuacgucccagaagcagcccc

SEQ ID NO: 541889 - RNA, 32 nt, Human
uuggcguggagcaggcgguggggagagaugga

SEQ ID NO: 541890 - RNA, 32 nt, Human
uuggcguucccaaguuucuccuugguccuccu

SEQ ID NO: 541891 - RNA, 32 nt, Human
uuggcguuuggcucugugcucucuggccaggu

SEQ ID NO: 541892 - RNA, 32 nt, Human
uuggcuaaacaacaugcaucucauuucuucuu

SEQ ID NO: 541893 - RNA, 32 nt, Human
uuggcuaaaggaugacauugcugguuauuugu

SEQ ID NO: 541894 - RNA, 32 nt, Human
uuggcuaacaaggugaaaccccgucucuacua

SEQ ID NO: 541895 - RNA, 32 nt, Human
uuggcuaacacagugaaaccccgucucuacua

SEQ ID NO: 541896 - RNA, 32 nt, Human
uuggcuaacagggugaaaccccgucucuacua

SEQ ID NO: 541897 - RNA, 32 nt, Human
uuggcuaacauggugaaacccuaucucuacua

SEQ ID NO: 541898 - RNA, 32 nt, Human
uuggcuaacauggugaaacccugucucuacua

SEQ ID NO: 541899 - RNA, 32 nt, Human
uuggcuaacugcaaccuccagcuccuggguuc

SEQ ID NO: 541900 - RNA, 32 nt, Human
uuggcuaacugcaaccuccgccucccagguuc

SEQ ID NO: 541901 - RNA, 32 nt, Human
uuggcuaacuuccagacuaugggaaaauaaau

SEQ ID NO: 541902 - RNA, 32 nt, Human
uuggcuaagaauugugucguuguggggugggc

SEQ ID NO: 541903 - RNA, 32 nt, Human
uuggcuaauauggugaaaccccaucucuacua

SEQ ID NO: 541904 - RNA, 32 nt, Human
uuggcuaauucuucuccuccuucacaucagaa

SEQ ID NO: 541905 - RNA, 32 nt, Human
uuggcuaauuuugucaagcacagcuguggugg

SEQ ID NO: 541906 - RNA, 32 nt, Human
uuggcuacacacaaaccaguaucgcucauaga

SEQ ID NO: 541907 - RNA, 32 nt, Human
uuggcuacacagggauguacaaggcgauccca

SEQ ID NO: 541908 - RNA, 32 nt, Human
uuggcuacagcagaccaaacagcccagcagcc

SEQ ID NO: 541909 - RNA, 21 nt, Human
uuggcuaccuccaccccucca

SEQ ID NO: 541910 - RNA, 32 nt, Human
uuggcuacucuuccucgucucagcagagcuca

SEQ ID NO: 541911 - RNA, 32 nt, Human
uuggcuagaaaaucaccagucuuuucucauua

SEQ ID NO: 541912 - RNA, 32 nt, Human
uuggcuagagccucauaaaagaccccagguuu

SEQ ID NO: 541913 - RNA, 32 nt, Human
uuggcuaggcuggaguaaaauggugcgaucuc

SEQ ID NO: 541914 - RNA, 32 nt, Human
uuggcuaggcuggucuugaacuccugagccuc

SEQ ID NO: 541915 - RNA, 32 nt, Human
uuggcuaggggaucacacgccccacauucugg

SEQ ID NO: 541916 - RNA, 32 nt, Human
uuggcuauccugggccccuggcuuucguuuuu

SEQ ID NO: 541917 - RNA, 32 nt, Human
uuggcuauggguggagggugaguuugaagagg

SEQ ID NO: 541918 - RNA, 32 nt, Human
uuggcuauggugaguaauacugcuauggauau

SEQ ID NO: 541919 - RNA, 32 nt, Human
uuggcuauuagucauuuuggcagcuugggcua

SEQ ID NO: 541920 - RNA, 32 nt, Human
uuggcuauugugaaaaacgaugcuauaaaugu

SEQ ID NO: 541921 - RNA, 32 nt, Human
uuggcuauuucucguucuuucugcacuguuuc

SEQ ID NO: 541922 - RNA, 32 nt, Human
uuggcucaaugcaaccuccaccucccagguuc

SEQ ID NO: 541923 - RNA, 32 nt, Human
uuggcucacaacugcaaccuccgucucccggg

SEQ ID NO: 541924 - RNA, 32 nt, Human
uuggcucacacagugcccuuccaauuuguauu

SEQ ID NO: 541925 - RNA, 32 nt, Human
uuggcucaccacaaccuccaccucccagguuc

SEQ ID NO: 541926 - RNA, 32 nt, Human
uuggcucaccacaaccuccgccucccggauuc

SEQ ID NO: 541927 - RNA, 32 nt, Human
uuggcucaccgcaaccuccgccucccagguuc

SEQ ID NO: 541928 - RNA, 32 nt, Human
uuggcucaccgcaaccuccgccucccggguuc

SEQ ID NO: 541929 - RNA, 32 nt, Human
uuggcucaccgcaaccucugccuaccggguuc

SEQ ID NO: 541930 - RNA, 32 nt, Human
uuggcucaccuuucucuccucagcagaacaug

SEQ ID NO: 541931 - RNA, 32 nt, Human
uuggcucacuacaaccuccaccucccagguuc

SEQ ID NO: 541932 - RNA, 32 nt, Human
uuggcucacuacaaccuccaccucccggguuc

SEQ ID NO: 541933 - RNA, 32 nt, Human
uuggcucacuacaaccuccaccuuccaggcuu

SEQ ID NO: 541934 - RNA, 32 nt, Human
uuggcucacuacaaccuccgccucccagguuc

SEQ ID NO: 541935 - RNA, 32 nt, Human
uuggcucacuauagccuugaccucucaggcuc

SEQ ID NO: 541936 - RNA, 32 nt, Human
uuggcucacuccaaccuccaccuuccagguuc

SEQ ID NO: 541937 - RNA, 32 nt, Human
uuggcucacuccaaccuccuccuggguuccag

SEQ ID NO: 541938 - RNA, 32 nt, Human
uuggcucacugcaaacccgccucccagguuua

SEQ ID NO: 541939 - RNA, 32 nt, Human
uuggcucacugcaaacuccgccuuccagguuc

SEQ ID NO: 541940 - RNA, 32 nt, Human
uuggcucacugcaaacucugccuaccagguuc

SEQ ID NO: 541941 - RNA, 32 nt, Human
uuggcucacugcaacauccgccucccggguuc

SEQ ID NO: 541942 - RNA, 32 nt, Human
uuggcucacugcaaccacugucucccggguuc

SEQ ID NO: 541943 - RNA, 32 nt, Human
uuggcucacugcaacccccaccucccggguuc

SEQ ID NO: 541944 - RNA, 32 nt, Human
uuggcucacugcaacccccgccuccaggguuc

SEQ ID NO: 541945 - RNA, 32 nt, Human
uuggcucacugcaaccccgccucccagguuca

SEQ ID NO: 541946 - RNA, 32 nt, Human
uuggcucacugcaacccucccucccggguucc

SEQ ID NO: 541947 - RNA, 32 nt, Human
uuggcucacugcaaccucagccucccagguuc

SEQ ID NO: 541948 - RNA, 32 nt, Human
uuggcucacugcaaccuccaccuccagguuca

SEQ ID NO: 541949 - RNA, 32 nt, Human
uuggcucacugcaaccuccaccucccaggucc

SEQ ID NO: 541950 - RNA, 32 nt, Human
uuggcucacugcaaccuccaccucccagguuc

SEQ ID NO: 541951 - RNA, 32 nt, Human
uuggcucacugcaaccuccaccucccaguuca

SEQ ID NO: 541952 - RNA, 32 nt, Human
uuggcucacugcaaccuccaccucccggguuc

SEQ ID NO: 541953 - RNA, 32 nt, Human
uuggcucacugcaaccuccaccuccugggcuc

SEQ ID NO: 541954 - RNA, 32 nt, Human
uuggcucacugcaaccuccaccuccuggguca

SEQ ID NO: 541955 - RNA, 32 nt, Human
uuggcucacugcaaccuccaccuccuggguuc

SEQ ID NO: 541956 - RNA, 32 nt, Human
uuggcucacugcaaccuccaccucugggauuc

SEQ ID NO: 541957 - RNA, 32 nt, Human
uuggcucacugcaaccuccaccuuccugguuc

SEQ ID NO: 541958 - RNA, 32 nt, Human
uuggcucacugcaaccuccacuucccagguuc

SEQ ID NO: 541959 - RNA, 32 nt, Human
uuggcucacugcaaccuccacuucccggguuc

SEQ ID NO: 541960 - RNA, 32 nt, Human
uuggcucacugcaaccuccacuuccuggguuc

SEQ ID NO: 541961 - RNA, 32 nt, Human
uuggcucacugcaaccuccacuucucagguuc

SEQ ID NO: 541962 - RNA, 32 nt, Human
uuggcucacugcaaccuccaggccagccucag

SEQ ID NO: 541963 - RNA, 32 nt, Human
uuggcucacugcaaccuccaucuccggggcuc

SEQ ID NO: 541964 - RNA, 32 nt, Human
uuggcucacugcaaccuccgacucccagguuc

SEQ ID NO: 541965 - RNA, 32 nt, Human
uuggcucacugcaaccuccgccuccagggcgc

SEQ ID NO: 541966 - RNA, 32 nt, Human
uuggcucacugcaaccuccgccuccaggguuc

SEQ ID NO: 541967 - RNA, 32 nt, Human
uuggcucacugcaaccuccgccucccagguuc

SEQ ID NO: 541968 - RNA, 32 nt, Human
uuggcucacugcaaccuccgccucccgaguuc

SEQ ID NO: 541969 - RNA, 32 nt, Human
uuggcucacugcaaccuccgccucccggguuc

SEQ ID NO: 541970 - RNA, 32 nt, Human
uuggcucacugcaaccuccgccucccugguuc

SEQ ID NO: 541971 - RNA, 32 nt, Human
uuggcucacugcaaccuccgccuccgggguuc

SEQ ID NO: 541972 - RNA, 32 nt, Human
uuggcucacugcaaccuccgccuccuggguua

SEQ ID NO: 541973 - RNA, 32 nt, Human
uuggcucacugcaaccuccgccuccuggguuc

SEQ ID NO: 541974 - RNA, 32 nt, Human
uuggcucacugcaaccuccgccucucagguuc

SEQ ID NO: 541975 - RNA, 32 nt, Human
uuggcucacugcaaccuccgccucucggguuc

SEQ ID NO: 541976 - RNA, 32 nt, Human
uuggcucacugcaaccuccgccucuuggguuc

SEQ ID NO: 541977 - RNA, 32 nt, Human
uuggcucacugcaaccuccgccuuccugguuc

SEQ ID NO: 541978 - RNA, 32 nt, Human
uuggcucacugcaaccuccgccuucuggguuc

SEQ ID NO: 541979 - RNA, 32 nt, Human
uuggcucacugcaaccuccgucucccagguuc

SEQ ID NO: 541980 - RNA, 32 nt, Human
uuggcucacugcaaccuccgucuuccggguuc

SEQ ID NO: 541981 - RNA, 32 nt, Human
uuggcucacugcaaccuccuccucccggguuc

SEQ ID NO: 541982 - RNA, 32 nt, Human
uuggcucacugcaaccucuaccuccuggguuc

SEQ ID NO: 541983 - RNA, 32 nt, Human
uuggcucacugcaaccucugcccccuggguuc

SEQ ID NO: 541984 - RNA, 32 nt, Human
uuggcucacugcaaccucugccuaccggauuc

SEQ ID NO: 541985 - RNA, 32 nt, Human
uuggcucacugcaaccucugccucacaggcuc

SEQ ID NO: 541986 - RNA, 32 nt, Human
uuggcucacugcaaccucugccucacagguuc

SEQ ID NO: 541987 - RNA, 32 nt, Human
uuggcucacugcaaccucugccucccagguuc

SEQ ID NO: 541988 - RNA, 32 nt, Human
uuggcucacugcaaccucugccucccgggcuc

SEQ ID NO: 541989 - RNA, 32 nt, Human
uuggcucacugcaaccucugccucccggguuc

SEQ ID NO: 541990 - RNA, 27 nt, Human
uuggcucacugcaaccucugccuccug

SEQ ID NO: 541991 - RNA, 32 nt, Human
uuggcucacugcaaccucugccuucuggguuc

SEQ ID NO: 541992 - RNA, 32 nt, Human
uuggcucacugcaaccucugcgggcucacgca

SEQ ID NO: 541993 - RNA, 32 nt, Human
uuggcucacugcaaccucugcuucccagguuu

SEQ ID NO: 541994 - RNA, 32 nt, Human
uuggcucacugcaaccucugcuucccgaguuc

SEQ ID NO: 541995 - RNA, 32 nt, Human
uuggcucacugcaaccucugcuucccggguuc

SEQ ID NO: 541996 - RNA, 32 nt, Human
uuggcucacugcaaccucugucucccagguuc

SEQ ID NO: 541997 - RNA, 32 nt, Human
uuggcucacugcaaccucugucuuccagguuc

SEQ ID NO: 541998 - RNA, 32 nt, Human
uuggcucacugcaacguccgccucccagguuc

SEQ ID NO: 541999 - RNA, 32 nt, Human
uuggcucacugcaacucugcuucccagguuca

SEQ ID NO: 542000 - RNA, 32 nt, Human
uuggcucacugcaacuuccaccucugggauca

SEQ ID NO: 542001 - RNA, 32 nt, Human
uuggcucacugcaacuuccacuucccggguuc

SEQ ID NO: 542002 - RNA, 32 nt, Human
uuggcucacugcaacuuccgccuccuguguuc

SEQ ID NO: 542003 - RNA, 32 nt, Human
uuggcucacugcaacuuccgucucccggguuc

SEQ ID NO: 542004 - RNA, 32 nt, Human
uuggcucacugcaacuucuaccuccgagguuc

SEQ ID NO: 542005 - RNA, 32 nt, Human
uuggcucacugcaacuucugccucuuggguuc

SEQ ID NO: 542006 - RNA, 32 nt, Human
uuggcucacugcaacuucugccuuccagguuc

SEQ ID NO: 542007 - RNA, 32 nt, Human
uuggcucacugcaacuugggccucccagguuc

SEQ ID NO: 542008 - RNA, 32 nt, Human
uuggcucacugcaagcuccaccuccuggguuc

SEQ ID NO: 542009 - RNA, 32 nt, Human
uuggcucacugcaagcuccgccucccagguuc

SEQ ID NO: 542010 - RNA, 32 nt, Human
uuggcucacugcaagcuccgccucccgaguuc

SEQ ID NO: 542011 - RNA, 32 nt, Human
uuggcucacugcaagcuccgccucccggcuuc

SEQ ID NO: 542012 - RNA, 32 nt, Human
uuggcucacugcaagcuccgccucccggguuc

SEQ ID NO: 542013 - RNA, 32 nt, Human
uuggcucacugcaagcuccgccucucggguuu

SEQ ID NO: 542014 - RNA, 32 nt, Human
uuggcucacugcaagcucugccucccggguuc

SEQ ID NO: 542015 - RNA, 32 nt, Human
uuggcucacugcaagcuuccccuuccggguuc

SEQ ID NO: 542016 - RNA, 32 nt, Human
uuggcucacugcaaucucuauccccuggguuc

SEQ ID NO: 542017 - RNA, 32 nt, Human
uuggcucacugcaaucucugccucucggguuc

SEQ ID NO: 542018 - RNA, 32 nt, Human
uuggcucacugcaaucucugccuuccggguuc

SEQ ID NO: 542019 - RNA, 32 nt, Human
uuggcucacugcacccuccgccuccugggcuc

SEQ ID NO: 542020 - RNA, 32 nt, Human
uuggcucacugcacccucugucuguugggcuc

SEQ ID NO: 542021 - RNA, 32 nt, Human
uuggcucacugcaccuccaccuuccgggcuca

SEQ ID NO: 542022 - RNA, 32 nt, Human
uuggcucacugcaccucugucucccaaguuca

SEQ ID NO: 542023 - RNA, 32 nt, Human
uuggcucacugcagccucaaccuguugggguc

SEQ ID NO: 542024 - RNA, 32 nt, Human
uuggcucacugcagccucaacuuccagcgcua

SEQ ID NO: 542025 - RNA, 32 nt, Human
uuggcucacugcagccucaacuucuuguccuc

SEQ ID NO: 542026 - RNA, 32 nt, Human
uuggcucacugcagccuccaccuccccgguuc

SEQ ID NO: 542027 - RNA, 32 nt, Human
uuggcucacugcagccuccaccucccggguuc

SEQ ID NO: 542028 - RNA, 32 nt, Human
uuggcucacugcagccuccaccuccugggcuc

SEQ ID NO: 542029 - RNA, 32 nt, Human
uuggcucacugcagccuccgccucccggguuc

SEQ ID NO: 542030 - RNA, 32 nt, Human
uuggcucacugcagccuccgccuucuggguuc

SEQ ID NO: 542031 - RNA, 32 nt, Human
uuggcucacugcagccucugccucccaggcuc

SEQ ID NO: 542032 - RNA, 32 nt, Human
uuggcucacugcagccucugccucccagguuc

SEQ ID NO: 542033 - RNA, 32 nt, Human
uuggcucacugcagccucugccucccggguuc

SEQ ID NO: 542034 - RNA, 32 nt, Human
uuggcucacugcagccucugcuccccaguagc

SEQ ID NO: 542035 - RNA, 32 nt, Human
uuggcucacugcagccuucgccucccggguuc

SEQ ID NO: 542036 - RNA, 32 nt, Human
uuggcucacugcaggcucugccucccgguuuc

SEQ ID NO: 542037 - RNA, 32 nt, Human
uuggcucacugcauccuccgccuuccagguuu

SEQ ID NO: 542038 - RNA, 32 nt, Human
uuggcucacugcugcaaccucccccuccuggg

SEQ ID NO: 542039 - RNA, 32 nt, Human
uuggcucacuguaaccuccaccucccaggcuc

SEQ ID NO: 542040 - RNA, 32 nt, Human
uuggcucacuucaaccuccgcccccaagguuc

SEQ ID NO: 542041 - RNA, 32 nt, Human
uuggcucagaauauccuuacaauuacaugaga

SEQ ID NO: 542042 - RNA, 32 nt, Human
uuggcucaggacugaagggaaggugguuggga

SEQ ID NO: 542043 - RNA, 32 nt, Human
uuggcucagugcaauccgccucccagguucaa

SEQ ID NO: 542044 - RNA, 32 nt, Human
uuggcucauaauccaggccucucuccacgugu

SEQ ID NO: 542045 - RNA, 32 nt, Human
uuggcucaucguaaccuccaccucccggguuc

SEQ ID NO: 542046 - RNA, 32 nt, Human
uuggcucauugcaaccuccgccucccucccag

SEQ ID NO: 542047 - RNA, 32 nt, Human
uuggcucauugcaaccucugccucccagguca

SEQ ID NO: 542048 - RNA, 32 nt, Human
uuggcucauuuaccuuuucucucccaucucau

SEQ ID NO: 542049 - RNA, 32 nt, Human
uuggcuccacuguaccgggggcugaggcccag

SEQ ID NO: 542050 - RNA, 32 nt, Human
uuggcuccaucccuccaggcucucauugugga

SEQ ID NO: 542051 - RNA, 32 nt, Human
uuggcucccacagcugcugccaguggccccca

SEQ ID NO: 542052 - RNA, 32 nt, Human
uuggcucccaggagcuccaggacagcccucug

SEQ ID NO: 542053 - RNA, 32 nt, Human
uuggcucccaggcuggaguccaguggugugau

SEQ ID NO: 542054 - RNA, 32 nt, Human
uuggcucccuacaacuuccaccucccagguuc

SEQ ID NO: 542055 - RNA, 32 nt, Human
uuggcucccuuccaccugucauucccaccacc

SEQ ID NO: 542056 - RNA, 32 nt, Human
uuggcuccuccccugguauaucuucuuuagug

SEQ ID NO: 542057 - RNA, 32 nt, Human
uuggcuccucuccccuuguuccugauuuuaau

SEQ ID NO: 542058 - RNA, 32 nt, Human
uuggcucgaugagcuuucucaaaggaaacaca

SEQ ID NO: 542059 - RNA, 32 nt, Human
uuggcucgcugcaaccucagcuuccagaguuc

SEQ ID NO: 542060 - RNA, 32 nt, Human
uuggcucgcugcaaccuccgccucccagguuc

SEQ ID NO: 542061 - RNA, 32 nt, Human
uuggcucgcugcaaccuucacccuucaccucc

SEQ ID NO: 542062 - RNA, 32 nt, Human
uuggcucgcugcagccuccaccucccagguuc

SEQ ID NO: 542063 - RNA, 32 nt, Human
uuggcucgcugcgccucugccucccagguuca

SEQ ID NO: 542064 - RNA, 32 nt, Human
uuggcucguggccccuuccuccaccuucaagc

SEQ ID NO: 542065 - RNA, 23 nt, Human
uuggcucuauuacuuucuguucc

SEQ ID NO: 542066 - RNA, 32 nt, Human
uuggcucucaucucccccauuccugugccuac

SEQ ID NO: 542067 - RNA, 32 nt, Human
uuggcucucgcaauuauggaggccaagaaguc

SEQ ID NO: 542068 - RNA, 23 nt, Human
uuggcucucuauagcauuuccug

SEQ ID NO: 542069 - RNA, 32 nt, Human
uuggcucucuauagcauuuccugacacuuccg

SEQ ID NO: 542070 - RNA, 32 nt, Human
uuggcucucugcaaccucugccucccagguuc

SEQ ID NO: 542071 - RNA, 32 nt, Human
uuggcucugcaaccuccacuucccagguucaa

SEQ ID NO: 542072 - RNA, 32 nt, Human
uuggcucugcaaccuccgccucccgguuuaaa

SEQ ID NO: 542073 - RNA, 32 nt, Human
uuggcucugcccaaggagaaauugugauguau

SEQ ID NO: 542074 - RNA, 32 nt, Human
uuggcucugugcauccuugaaaccagaaaggu

SEQ ID NO: 542075 - RNA, 32 nt, Human
uuggcucuuagcaaagcagguggcccacagug

SEQ ID NO: 542076 - RNA, 32 nt, Human
uuggcucuucauuuccaguguuucuacagugc

SEQ ID NO: 542077 - RNA, 32 nt, Human
uuggcucuuugaucuuaccucuacuccucuga

SEQ ID NO: 542078 - RNA, 32 nt, Human
uuggcugaacagggaaggaaaauaugucaaga

SEQ ID NO: 542079 - RNA, 32 nt, Human
uuggcugaaccugggagaccagcugggccucc

SEQ ID NO: 542080 - RNA, 32 nt, Human
uuggcugaaggugggagccggugugggagcuu

SEQ ID NO: 542081 - RNA, 32 nt, Human
uuggcugagacaauacaugugcaucauuuugg

SEQ ID NO: 542082 - RNA, 32 nt, Human
uuggcugagaggagggggagaaggaggggaag

SEQ ID NO: 542083 - RNA, 32 nt, Human
uuggcugagagggcuaccugcccagccccucc

SEQ ID NO: 542084 - RNA, 32 nt, Human
uuggcugagccccauucugggucaggcccucc

SEQ ID NO: 542085 - RNA, 32 nt, Human
uuggcugagccuggcuggagagcugcuaugcu

SEQ ID NO: 542086 - RNA, 32 nt, Human
uuggcugaguacucagagaauggaagcaccac

SEQ ID NO: 542087 - RNA, 32 nt, Human
uuggcugagucuggaaugucugccugugccuc

SEQ ID NO: 542088 - RNA, 32 nt, Human
uuggcugagugggcaccggcugccucaugguu

SEQ ID NO: 542089 - RNA, 32 nt, Human
uuggcugauacuccuaugcuugaguucaaagg

SEQ ID NO: 542090 - RNA, 32 nt, Human
uuggcugaugaaguaccugcucagcuuagcua

SEQ ID NO: 542091 - RNA, 32 nt, Human
uuggcugaugccucucauuaagaguugaaaac

SEQ ID NO: 542092 - RNA, 32 nt, Human
uuggcugauuauugcugccuauuuuagaacau

SEQ ID NO: 542093 - RNA, 32 nt, Human
uuggcugcaaagaaaucugcuuggaagaaggg

SEQ ID NO: 542094 - RNA, 32 nt, Human
uuggcugcaaguaacagaaacuccuaauucaa

SEQ ID NO: 542095 - RNA, 32 nt, Human
uuggcugcaggacucagagcauggacaggugg

SEQ ID NO: 542096 - RNA, 32 nt, Human
uuggcugcauagaagaaaaagguagaguuauu

SEQ ID NO: 542097 - RNA, 32 nt, Human
uuggcugccaagcacgcagaucccauggacau

SEQ ID NO: 542098 - RNA, 22 nt, Human
uuggcugccaucaucccuccca

SEQ ID NO: 542099 - RNA, 32 nt, Human
uuggcugcccaaagugcugggauuacaggcaa

SEQ ID NO: 542100 - RNA, 32 nt, Human
uuggcugcccugcuugugggccuguguggcac

SEQ ID NO: 542101 - RNA, 32 nt, Human
uuggcugccguuuuuaaauacuacccaagaag

SEQ ID NO: 542102 - RNA, 32 nt, Human
uuggcugccuccagaagagaugcagagagcug

SEQ ID NO: 542103 - RNA, 32 nt, Human
uuggcugccucugaggcuccccugggcugcgu

SEQ ID NO: 542104 - RNA, 32 nt, Human
uuggcugccuguggagcuccugugccagcagc

SEQ ID NO: 542105 - RNA, 32 nt, Human
uuggcugcuaaggaaacuuccucuccauugca

SEQ ID NO: 542106 - RNA, 32 nt, Human
uuggcugcuggcugagaggucacagcucugcc

SEQ ID NO: 542107 - RNA, 32 nt, Human
uuggcugcugggauagauaagcaugggcuuaa

SEQ ID NO: 542108 - RNA, 32 nt, Human
uuggcugcugugaccagaaacugcccaggccu

SEQ ID NO: 542109 - RNA, 32 nt, Human
uuggcugcuuagcaucccaagacuggaccugg

SEQ ID NO: 542110 - RNA, 32 nt, Human
uuggcugcuuagugggacugguggcccagaga

SEQ ID NO: 542111 - RNA, 19 nt, Human
uuggcugcuucuggggccu

SEQ ID NO: 542112 - RNA, 32 nt, Human
uuggcuggacccuauccuccuggcugauucug

SEQ ID NO: 542113 - RNA, 32 nt, Human
uuggcuggagaagaaaggacaagaggcagcag

SEQ ID NO: 542114 - RNA, 32 nt, Human
uuggcuggagcggagaugaggggccaccccgu

SEQ ID NO: 542115 - RNA, 32 nt, Human
uuggcuggcccagcugcucaggagccgggcug

SEQ ID NO: 542116 - RNA, 32 nt, Human
uuggcugggaaucuccaccuuaauccuuaaag

SEQ ID NO: 542117 - RNA, 32 nt, Human
uuggcugggaccccucauuaaccaaccaagca

SEQ ID NO: 542118 - RNA, 32 nt, Human
uuggcugggauuacaggcaugagccacugcac

SEQ ID NO: 542119 - RNA, 32 nt, Human
uuggcugggucugagugccacccccaggccac

SEQ ID NO: 542120 - RNA, 32 nt, Human
uuggcuggucucaaacuccugaccuuauaauc

SEQ ID NO: 542121 - RNA, 32 nt, Human
uuggcuggucugugcucugcuaggugaaaaau

SEQ ID NO: 542122 - RNA, 32 nt, Human
uuggcuggugcuggugccauggacucugccca

SEQ ID NO: 542123 - RNA, 32 nt, Human
uuggcugguggagaaggaggaggcagaauguc

SEQ ID NO: 542124 - RNA, 32 nt, Human
uuggcugguucuuuguucugucccccaugcuc

SEQ ID NO: 542125 - RNA, 32 nt, Human
uuggcuguaaguugccauuugaacuaaacgaa

SEQ ID NO: 542126 - RNA, 32 nt, Human
uuggcuguauguuauguaagauuuaauauguu

SEQ ID NO: 542127 - RNA, 32 nt, Human
uuggcugucaaaaggaggcaggagcaguucuc

SEQ ID NO: 542128 - RNA, 32 nt, Human
uuggcugucuggccucucaggugucagggcca

SEQ ID NO: 542129 - RNA, 32 nt, Human
uuggcugugaccugggggccucaggccuaacc

SEQ ID NO: 542130 - RNA, 32 nt, Human
uuggcugugagcuccuggggguggggguggcg

SEQ ID NO: 542131 - RNA, 32 nt, Human
uuggcugugagcuccuuggguacggguaccuu

SEQ ID NO: 542132 - RNA, 32 nt, Human
uuggcugugcugguucagcuagcucuccugag

SEQ ID NO: 542133 - RNA, 31 nt, Human
uuggcugugguggaaacuuugguggaggagg

SEQ ID NO: 542134 - RNA, 32 nt, Human
uuggcuguucagacagaagagcugaaucagca

SEQ ID NO: 542135 - RNA, 18 nt, Human
uuggcuguuugggauuuu

SEQ ID NO: 542136 - RNA, 32 nt, Human
uuggcuuaaagugaaaaagaagaaauagagaa

SEQ ID NO: 542137 - RNA, 32 nt, Human
uuggcuuacuauauacauucuugguggauaaa

SEQ ID NO: 542138 - RNA, 32 nt, Human
uuggcuuacugcaaccuccaccucccagguuc

SEQ ID NO: 542139 - RNA, 32 nt, Human
uuggcuuacugcaaccuccaccuccuggguuc

SEQ ID NO: 542140 - RNA, 32 nt, Human
uuggcuuacugcaaccuccgccucccagguuc

SEQ ID NO: 542141 - RNA, 32 nt, Human
uuggcuuacugcaaccuccgccuccuggguuc

SEQ ID NO: 542142 - RNA, 32 nt, Human
uuggcuuacugcaaccucugccucccagguuu

SEQ ID NO: 542143 - RNA, 32 nt, Human
uuggcuuacugcaacuuccgacucccagguuc

SEQ ID NO: 542144 - RNA, 32 nt, Human
uuggcuuagguuucagcgcccuucucaacccc

SEQ ID NO: 542145 - RNA, 32 nt, Human
uuggcuuaugaccagucugauugguugcagga

SEQ ID NO: 542146 - RNA, 32 nt, Human
uuggcuucacauaacauaucccuuagaacaga

SEQ ID NO: 542147 - RNA, 32 nt, Human
uuggcuucaugacaccacaguccuggucuuuc

SEQ ID NO: 542148 - RNA, 32 nt, Human
uuggcuuccacucagcaucagcguggcaguca

SEQ ID NO: 542149 - RNA, 32 nt, Human
uuggcuucccaaaguccugggauuacaggugu

SEQ ID NO: 542150 - RNA, 32 nt, Human
uuggcuucccaaagugcugggauuacaggcau

SEQ ID NO: 542151 - RNA, 32 nt, Human
uuggcuucccaaagugcugggauuacaggcgu

SEQ ID NO: 542152 - RNA, 32 nt, Human
uuggcuucccaaagugcugggauuauaggcag

SEQ ID NO: 542153 - RNA, 32 nt, Human
uuggcuucccaaagugcugggauuauaggcau

SEQ ID NO: 542154 - RNA, 32 nt, Human
uuggcuuccucgaaaagcaaagugaucuugaa

SEQ ID NO: 542155 - RNA, 32 nt, Human
uuggcuuccuuucuugguucauaaaugaauuu

SEQ ID NO: 542156 - RNA, 32 nt, Human
uuggcuucuaggaacaguugacuucccagaau

SEQ ID NO: 542157 - RNA, 32 nt, Human
uuggcuucuuucacucugggcuguguuuauga

SEQ ID NO: 542158 - RNA, 32 nt, Human
uuggcuugcuuccucuugacuauugggaguag

SEQ ID NO: 542159 - RNA, 32 nt, Human
uuggcuuggaaucaccaacucugccuguauug

SEQ ID NO: 542160 - RNA, 32 nt, Human
uuggcuuggaggcugagguaggaggaucgccu

SEQ ID NO: 542161 - RNA, 32 nt, Human
uuggcuuggcaucugcacuccagcccaggacu

SEQ ID NO: 542162 - RNA, 32 nt, Human
uuggcuugggaguagaagaagggucgucccug

SEQ ID NO: 542163 - RNA, 32 nt, Human
uuggcuuggucucuacccucacuaccucaguu

SEQ ID NO: 542164 - RNA, 32 nt, Human
uuggcuuggugaggacagcaggaggggcccac

SEQ ID NO: 542165 - RNA, 32 nt, Human
uuggcuuguaaaccuucgucucccucucuuuu

SEQ ID NO: 542166 - RNA, 32 nt, Human
uuggcuuuauuuuggggaaucaggggugagga

SEQ ID NO: 542167 - RNA, 32 nt, Human
uuggcuuucaaacauccuccuggcuugaguuu

SEQ ID NO: 542168 - RNA, 32 nt, Human
uuggcuuuccaaaguguugggauuacaagcgu

SEQ ID NO: 542169 - RNA, 32 nt, Human
uuggcuuucugcaaccucugccucccagguuc

SEQ ID NO: 542170 - RNA, 32 nt, Human
uuggcuuuuauccuagcaacuuacuuaagccu

SEQ ID NO: 542171 - RNA, 32 nt, Human
uuggcuuuucuccaagucuacgacgacgagcu

SEQ ID NO: 542172 - RNA, 32 nt, Human
uuggcuuuucugcagggucucugugauuuccc

SEQ ID NO: 542173 - RNA, 18 nt, Human
uuggcuuuucuggauuuu

SEQ ID NO: 542174 - RNA, 32 nt, Human
uuggcuuuugccacuuucuuccuugccuuugc

SEQ ID NO: 542175 - RNA, 32 nt, Human
uuggcuuuuugaaaaauugucuuuccuuauca

SEQ ID NO: 542176 - RNA, 32 nt, Human
uuggcuuuuugauaaacugcggccugcucuca

SEQ ID NO: 542177 - RNA, 22 nt, Human
uugggaaaacuacagagcuagg

SEQ ID NO: 542178 - RNA, 32 nt, Human
uugggaaaauagagaagagcaagagcaacaac

SEQ ID NO: 542179 - RNA, 23 nt, Human
uugggaaacagguaaaagcaagg

SEQ ID NO: 542180 - RNA, 32 nt, Human
uugggaaagagacagagugcugaggggcacuc

SEQ ID NO: 542181 - RNA, 32 nt, Human
uugggaaaggaggcaguggcagagggguugag

SEQ ID NO: 542182 - RNA, 32 nt, Human
uugggaaaugacuggggagacaccugaaagga

SEQ ID NO: 542183 - RNA, 31 nt, Human
uugggaacaugcuggaaauaaaacagcugca

SEQ ID NO: 542184 - RNA, 32 nt, Human
uugggaacaugcuggaaauaaaacagcugcac

SEQ ID NO: 542185 - RNA, 32 nt, Human
uugggaacccgaggcagguggaucaccugagg

SEQ ID NO: 542186 - RNA, 32 nt, Human
uugggaaccucauuagaaaugaccucagcugc

SEQ ID NO: 542187 - RNA, 32 nt, Human
uugggaacguggaaaagggucacugaauggga

SEQ ID NO: 542188 - RNA, 32 nt, Human
uugggaacuaccugcaucuucaguccccuuga

SEQ ID NO: 542189 - RNA, 32 nt, Human
uugggaacuauacucuuuuuauuuuuauuuuu

SEQ ID NO: 542190 - RNA, 32 nt, Human
uugggaacuccuaaccuagaacuaucugccau

SEQ ID NO: 542191 - RNA, 32 nt, Human
uugggaagaaauaggccucucccccaguccca

SEQ ID NO: 542192 - RNA, 32 nt, Human
uugggaagaagaucagauaauuagcuguaaug

SEQ ID NO: 542193 - RNA, 32 nt, Human
uugggaagacuccuagcuguccuuuuuccucu

SEQ ID NO: 542194 - RNA, 32 nt, Human
uugggaagagaaaguuaucaagagaaagaggu

SEQ ID NO: 542195 - RNA, 32 nt, Human
uugggaagagagagggacagggacaagggcaa

SEQ ID NO: 542196 - RNA, 32 nt, Human
uugggaagcagaggcuggaggaucauuucagc

SEQ ID NO: 542197 - RNA, 32 nt, Human
uugggaagcccaggcaggcagaucacuugagg

SEQ ID NO: 542198 - RNA, 32 nt, Human
uugggaagcccaggcgggcggaucacuugagg

SEQ ID NO: 542199 - RNA, 32 nt, Human
uugggaagccgaagcaggaggaucacuggagg

SEQ ID NO: 542200 - RNA, 32 nt, Human
uugggaagcuaaauaucaucuaucuucuagaa

SEQ ID NO: 542201 - RNA, 32 nt, Human
uugggaagcucugccuuggacucucccccacc

SEQ ID NO: 542202 - RNA, 32 nt, Human
uugggaagcugaagcaggagaaucacuuaaac

SEQ ID NO: 542203 - RNA, 32 nt, Human
uugggaagcugaagcaggaggauugcuugagc

SEQ ID NO: 542204 - RNA, 32 nt, Human
uugggaagcugaggaaggagaauugcuugaac

SEQ ID NO: 542205 - RNA, 32 nt, Human
uugggaagcugagguaggagaaucgcuugaac

SEQ ID NO: 542206 - RNA, 32 nt, Human
uugggaagcugagguggacggaucauuugagg

SEQ ID NO: 542207 - RNA, 32 nt, Human
uugggaaggaacagccuaaagaugcuuuguaa

SEQ ID NO: 542208 - RNA, 32 nt, Human
uugggaaggaaggucugaguucccugggaacu

SEQ ID NO: 542209 - RNA, 32 nt, Human
uugggaaggacacagcaguauuggacgguuuc

SEQ ID NO: 542210 - RNA, 32 nt, Human
uugggaagggagcugggggaggcaguggcggc

SEQ ID NO: 542211 - RNA, 32 nt, Human
uugggaaggugggcaggggcaagugaacucag

SEQ ID NO: 542212 - RNA, 32 nt, Human
uugggaaguggaggugggagaaucacuugagc

SEQ ID NO: 542213 - RNA, 32 nt, Human
uugggaagugggagcgggagggccgggcaauu

SEQ ID NO: 542214 - RNA, 32 nt, Human
uugggaaguuguuuauguggcuugugugcugg

SEQ ID NO: 542215 - RNA, 32 nt, Human
uugggaauaggcagggucagauuccagggcau

SEQ ID NO: 542216 - RNA, 32 nt, Human
uugggaaucaugguuuguuugcauuaguauga

SEQ ID NO: 542217 - RNA, 32 nt, Human
uugggaaugagcugaggcggauuuccccagag

SEQ ID NO: 542218 - RNA, 32 nt, Human
uugggaaugaguuggcucuggacguuucugcc

SEQ ID NO: 542219 - RNA, 32 nt, Human
uugggaauguuugucucaucccauucugcguc

SEQ ID NO: 542220 - RNA, 32 nt, Human
uugggacaagauaacauagcagaggaauuaau

SEQ ID NO: 542221 - RNA, 32 nt, Human
uugggacaccgaggcaggagaaucacuugaac

SEQ ID NO: 542222 - RNA, 32 nt, Human
uugggacagaguuucacucuuguugcccaggc

SEQ ID NO: 542223 - RNA, 32 nt, Human
uugggacaggcgccuaccugcuccucgggcac

SEQ ID NO: 542224 - RNA, 32 nt, Human
uugggacaugaaguuaaccacagucgggaaac

SEQ ID NO: 542225 - RNA, 22 nt, Human
uugggaccacaggcgugaacca

SEQ ID NO: 542226 - RNA, 32 nt, Human
uugggaccagccugaccaacauggugaaauau

SEQ ID NO: 542227 - RNA, 32 nt, Human
uugggaccagccuggccaacauggugaaaccc

SEQ ID NO: 542228 - RNA, 32 nt, Human
uugggaccagccugggcuauauagcaagaccc

SEQ ID NO: 542229 - RNA, 32 nt, Human
uugggaccccacacacuccaggugggaucaga

SEQ ID NO: 542230 - RNA, 32 nt, Human
uugggaccccacccuccuaucauggcccagga

SEQ ID NO: 542231 - RNA, 32 nt, Human
uugggaccccugauuuuagcaggauggcccaa

SEQ ID NO: 542232 - RNA, 32 nt, Human
uugggacccuccagugcuggauuugaugaguu

SEQ ID NO: 542233 - RNA, 32 nt, Human
uugggacccugacaguggggaaggcagaggag

SEQ ID NO: 542234 - RNA, 32 nt, Human
uugggacccugcgcauccccaucagggguucu

SEQ ID NO: 542235 - RNA, 32 nt, Human
uugggacccuuaaguguucugcaccuggggag

SEQ ID NO: 542236 - RNA, 32 nt, Human
uugggacccuugcaugguguuucaaagggugg

SEQ ID NO: 542237 - RNA, 32 nt, Human
uugggaccucaguuuucuuuuuguuuguuugu

SEQ ID NO: 542238 - RNA, 32 nt, Human
uugggaccugggaaguggggaccugggcagcg

SEQ ID NO: 542239 - RNA, 32 nt, Human
uugggacgcugcggccuggccuucaggccacu

SEQ ID NO: 542240 - RNA, 22 nt, Human
uugggacuacaggcgugagcca

SEQ ID NO: 542241 - RNA, 25 nt, Human
uugggacucaaggacuuugcugcug

SEQ ID NO: 542242 - RNA, 32 nt, Human
uugggacucccagggcagccagucugccccac

SEQ ID NO: 542243 - RNA, 32 nt, Human
uugggacugagcagcugggagcaggcgaccga

SEQ ID NO: 542244 - RNA, 20 nt, Human
uugggacugccuggcaacau

SEQ ID NO: 542245 - RNA, 32 nt, Human
uugggacuucuggcugcaauaggagcaaggga

SEQ ID NO: 542246 - RNA, 32 nt, Human
uugggacuucugguuuuggcuuuuucuuuuua

SEQ ID NO: 542247 - RNA, 32 nt, Human
uugggagaaaggcccuguuucccuggaacugc

SEQ ID NO: 542248 - RNA, 21 nt, Human
uugggagaacacccuacugcu

SEQ ID NO: 542249 - RNA, 32 nt, Human
uugggagaauggaaagcagaaagggaagccag

SEQ ID NO: 542250 - RNA, 32 nt, Human
uugggagaccgaggcaggcggaucaugagguc

SEQ ID NO: 542251 - RNA, 32 nt, Human
uugggagaccgaggcagguggaucaccugagg

SEQ ID NO: 542252 - RNA, 32 nt, Human
uugggagaccgaggcagguggaucacgagguc

SEQ ID NO: 542253 - RNA, 32 nt, Human
uugggagacuccaagacagcagcuccgagguc

SEQ ID NO: 542254 - RNA, 32 nt, Human
uugggagacugaggagggagaaucacuugagg

SEQ ID NO: 542255 - RNA, 32 nt, Human
uugggagacugaggcaagagaaucacuugaac

SEQ ID NO: 542256 - RNA, 32 nt, Human
uugggagacugaggcaggagaaucacuugaac

SEQ ID NO: 542257 - RNA, 32 nt, Human
uugggagacugaggcaggagaaucgcaugaac

SEQ ID NO: 542258 - RNA, 32 nt, Human
uugggagacugaggcaggagaaugauuugaac

SEQ ID NO: 542259 - RNA, 32 nt, Human
uugggagacugaggcaggagaauggcuugaac

SEQ ID NO: 542260 - RNA, 32 nt, Human
uugggagacugaggcaggagaauugcuugaaa

SEQ ID NO: 542261 - RNA, 32 nt, Human
uugggagacugaggcaggagaauugcuugaac

SEQ ID NO: 542262 - RNA, 32 nt, Human
uugggagacugaggcggaucaccugaggucag

SEQ ID NO: 542263 - RNA, 32 nt, Human
uugggagaggagaaaagaucugagaauguccu

SEQ ID NO: 542264 - RNA, 32 nt, Human
uugggagaggagagaagcuggacuccaggcau

SEQ ID NO: 542265 - RNA, 32 nt, Human
uugggagagggggagggaggggagacagagcc

SEQ ID NO: 542266 - RNA, 23 nt, Human
uugggagagugagacccagugga

SEQ ID NO: 542267 - RNA, 32 nt, Human
uugggagaguggugaguggaagggaggagcag

SEQ ID NO: 542268 - RNA, 32 nt, Human
uugggagaugcagcuuagccacaugcccauaa

SEQ ID NO: 542269 - RNA, 22 nt, Human
uugggagcacagcucuauucug

SEQ ID NO: 542270 - RNA, 22 nt, Human
uugggagcagaaguguccccgg

SEQ ID NO: 542271 - RNA, 32 nt, Human
uugggagcagcagccaccuggccucacucugg

SEQ ID NO: 542272 - RNA, 32 nt, Human
uugggagcagcucugcgugcggggccucagag

SEQ ID NO: 542273 - RNA, 32 nt, Human
uugggagcauggcagacagggaagggaaacau

SEQ ID NO: 542274 - RNA, 32 nt, Human
uugggagcauugagauguaagcucaggguuac

SEQ ID NO: 542275 - RNA, 32 nt, Human
uugggagccacugccacuccaguccugccacc

SEQ ID NO: 542276 - RNA, 32 nt, Human
uugggagccagccugccaacagccaccugggc

SEQ ID NO: 542277 - RNA, 23 nt, Human
uugggagccagcuacaacccaaa

SEQ ID NO: 542278 - RNA, 32 nt, Human
uugggagccagcugagaagagagcagacucac

SEQ ID NO: 542279 - RNA, 32 nt, Human
uugggagccauggagagugacuuuuaucugcg

SEQ ID NO: 542280 - RNA, 24 nt, Human
uugggagccauuagccuugcucug

SEQ ID NO: 542281 - RNA, 32 nt, Human
uugggagcccgaggcggguggaucagcugagg

SEQ ID NO: 542282 - RNA, 32 nt, Human
uugggagcccucaagugucuccuguccuugcc

SEQ ID NO: 542283 - RNA, 32 nt, Human
uugggagccucacugaacgccugcucugguug

SEQ ID NO: 542284 - RNA, 32 nt, Human
uugggagccugaggcaggagaacugcuugaac

SEQ ID NO: 542285 - RNA, 32 nt, Human
uugggagccugaggcaggcggaucaugagguc

SEQ ID NO: 542286 - RNA, 32 nt, Human
uugggagccugaggggccaucucccugacacu

SEQ ID NO: 542287 - RNA, 32 nt, Human
uugggagccuggggcaggagaaucacuugaac

SEQ ID NO: 542288 - RNA, 32 nt, Human
uugggagcgagggacaggagaauaauuuugau

SEQ ID NO: 542289 - RNA, 32 nt, Human
uugggagcgggcuuccagcucucagugggcag

SEQ ID NO: 542290 - RNA, 32 nt, Human
uugggagcucuauggcccuccccaccaccuga

SEQ ID NO: 542291 - RNA, 31 nt, Human
uugggagcugcucuaguuacauuccucccuu

SEQ ID NO: 542292 - RNA, 32 nt, Human
uugggagcuuuggcuuuugaucuuaagcuuau

SEQ ID NO: 542293 - RNA, 19 nt, Human
uugggaggaaggggcuacu

SEQ ID NO: 542294 - RNA, 32 nt, Human
uugggaggaagugccugcagccagguccugaa

SEQ ID NO: 542295 - RNA, 32 nt, Human
uugggaggacgaggcaggcggaucaugagguc

SEQ ID NO: 542296 - RNA, 32 nt, Human
uugggaggacgaggcggguggaucacucgaug

SEQ ID NO: 542297 - RNA, 32 nt, Human
uugggaggagcagagccagggagccaucuaca

SEQ ID NO: 542298 - RNA, 32 nt, Human
uugggaggagcagucucuccgcucgucucccg

SEQ ID NO: 542299 - RNA, 32 nt, Human
uugggaggaugaggcaggagaaucgcuugaac

SEQ ID NO: 542300 - RNA, 32 nt, Human
uugggaggcaaaggcagguggaucaccugagg

SEQ ID NO: 542301 - RNA, 32 nt, Human
uugggaggcagaggcaggagaaucauuugaac

SEQ ID NO: 542302 - RNA, 32 nt, Human
uugggaggcagaggcaggagaaucgcuugaac

SEQ ID NO: 542303 - RNA, 32 nt, Human
uugggaggcagaggcaggagaaucguuugaac

SEQ ID NO: 542304 - RNA, 32 nt, Human
uugggaggcagaggcaggagaauugcuugaac

SEQ ID NO: 542305 - RNA, 32 nt, Human
uugggaggcagaggcaggagaauugcuugagc

SEQ ID NO: 542306 - RNA, 32 nt, Human
uugggaggcagaggcagguggaucaccugagg

SEQ ID NO: 542307 - RNA, 32 nt, Human
uugggaggcagugggagaaucgcuugagcccg

SEQ ID NO: 542308 - RNA, 32 nt, Human
uugggaggccaaagcaggacgaucacuugagc

SEQ ID NO: 542309 - RNA, 32 nt, Human
uugggaggccaaagcaggaggauagcuugagg

SEQ ID NO: 542310 - RNA, 32 nt, Human
uugggaggccaaagcaggaggaucacuugagc

SEQ ID NO: 542311 - RNA, 32 nt, Human
uugggaggccaaagcaggaggaucgcuugagc

SEQ ID NO: 542312 - RNA, 32 nt, Human
uugggaggccaagaugggaggaucauuugagc

SEQ ID NO: 542313 - RNA, 32 nt, Human
uugggaggccaaggcagauggaucaugagguc

SEQ ID NO: 542314 - RNA, 32 nt, Human
uugggaggccaaggcaggagaagcgcuugagg

SEQ ID NO: 542315 - RNA, 32 nt, Human
uugggaggccaaggcaggagaaucgcucgaaa

SEQ ID NO: 542316 - RNA, 32 nt, Human
uugggaggccaaggcaggagaaucgcuugaac

SEQ ID NO: 542317 - RNA, 32 nt, Human
uugggaggccaaggcaggagaaugacaugaac

SEQ ID NO: 542318 - RNA, 32 nt, Human
uugggaggccaaggcagguagauuaugagguc

SEQ ID NO: 542319 - RNA, 32 nt, Human
uugggaggccaaggcagguggaucaccugagg

SEQ ID NO: 542320 - RNA, 32 nt, Human
uugggaggccaaggcagguggaucacgagguc

SEQ ID NO: 542321 - RNA, 32 nt, Human
uugggaggccaaggcagguggaucacuuaaga

SEQ ID NO: 542322 - RNA, 32 nt, Human
uugggaggccaaggcagguggaucacuugagg

SEQ ID NO: 542323 - RNA, 32 nt, Human
uugggaggccaaggcagguggaucaugauguc

SEQ ID NO: 542324 - RNA, 32 nt, Human
uugggaggccaaggcagguggaucauuugagg

SEQ ID NO: 542325 - RNA, 32 nt, Human
uugggaggccaaggcaggugggucaccugggg

SEQ ID NO: 542326 - RNA, 32 nt, Human
uugggaggccaaggcggguggaucaauugagg

SEQ ID NO: 542327 - RNA, 32 nt, Human
uugggaggccaaggcggguggaucacaagguc

SEQ ID NO: 542328 - RNA, 32 nt, Human
uugggaggccaaggcggguggaucacccgagg

SEQ ID NO: 542329 - RNA, 32 nt, Human
uugggaggccaaggcggguggaucaccugaca

SEQ ID NO: 542330 - RNA, 32 nt, Human
uugggaggccaaggcggguggaucaccugaga

SEQ ID NO: 542331 - RNA, 32 nt, Human
uugggaggccaaggcggguggaucaccugagg

SEQ ID NO: 542332 - RNA, 32 nt, Human
uugggaggccaaggcggguggaucacuugaga

SEQ ID NO: 542333 - RNA, 32 nt, Human
uugggaggccaaggcggguggaucacuugagg

SEQ ID NO: 542334 - RNA, 32 nt, Human
uugggaggccaagguggguggaucaucuaagg

SEQ ID NO: 542335 - RNA, 32 nt, Human
uugggaggccacccucuaccuucuugccuuuu

SEQ ID NO: 542336 - RNA, 32 nt, Human
uugggaggccacggcagguggaucaucugagg

SEQ ID NO: 542337 - RNA, 32 nt, Human
uugggaggccauagcaggaggauugcucgagc

SEQ ID NO: 542338 - RNA, 32 nt, Human
uugggaggccauggcagguggaucaccugagg

SEQ ID NO: 542339 - RNA, 32 nt, Human
uugggaggcccagacuggcggaucaccugagg

SEQ ID NO: 542340 - RNA, 32 nt, Human
uugggaggcccagauggggaggaucacuugac

SEQ ID NO: 542341 - RNA, 32 nt, Human
uugggaggcccaggcagacagaucaccagaug

SEQ ID NO: 542342 - RNA, 32 nt, Human
uugggaggcccaggcaggcagaucaccugagg

SEQ ID NO: 542343 - RNA, 32 nt, Human
uugggaggcccaggcaggcggaucacuugagg

SEQ ID NO: 542344 - RNA, 32 nt, Human
uugggaggcccaggcaggcgggucaugagguc

SEQ ID NO: 542345 - RNA, 25 nt, Human
uugggaggcccaggcgggcggauca

SEQ ID NO: 542346 - RNA, 32 nt, Human
uugggaggcccaggcgggcggaucacaagguc

SEQ ID NO: 542347 - RNA, 32 nt, Human
uugggaggcccaggcgggcggaucacgagguc

SEQ ID NO: 542348 - RNA, 32 nt, Human
uugggaggcccaggcggguggaucaaagguca

SEQ ID NO: 542349 - RNA, 32 nt, Human
uugggaggcccaggcggucgggucacgagguc

SEQ ID NO: 542350 - RNA, 32 nt, Human
uugggaggcccaggucaggggaucauuaaguc

SEQ ID NO: 542351 - RNA, 32 nt, Human
uugggaggcccaggugggcagaucaccugaag

SEQ ID NO: 542352 - RNA, 32 nt, Human
uugggaggcccaggugggcggaucacgaaguc

SEQ ID NO: 542353 - RNA, 32 nt, Human
uugggaggcccagguggggcgaucaccugagg

SEQ ID NO: 542354 - RNA, 32 nt, Human
uugggaggccgaaacaggcgaaucacuugagc

SEQ ID NO: 542355 - RNA, 32 nt, Human
uugggaggccgaagcaggaggauugcuugaau

SEQ ID NO: 542356 - RNA, 32 nt, Human
uugggaggccgaagcaggcggaucacgagguc

SEQ ID NO: 542357 - RNA, 32 nt, Human
uugggaggccgaagcaggcggaucacuugagg

SEQ ID NO: 542358 - RNA, 32 nt, Human
uugggaggccgaagcagguggaucacuugagg

SEQ ID NO: 542359 - RNA, 32 nt, Human
uugggaggccgaagcagguggaucaucugagg

SEQ ID NO: 542360 - RNA, 32 nt, Human
uugggaggccgaagcggguggaucaccugagg

SEQ ID NO: 542361 - RNA, 32 nt, Human
uugggaggccgacgugggagaaucacuugagc

SEQ ID NO: 542362 - RNA, 32 nt, Human
uugggaggccgagaaggguggaucaugagguc

SEQ ID NO: 542363 - RNA, 32 nt, Human
uugggaggccgagacaggcggaucaccugagg

SEQ ID NO: 542364 - RNA, 32 nt, Human
uugggaggccgagacagguggaucacgagguc

SEQ ID NO: 542365 - RNA, 32 nt, Human
uugggaggccgagacgggcacaucauuugagg

SEQ ID NO: 542366 - RNA, 32 nt, Human
uugggaggccgagacggguggaucaccugagg

SEQ ID NO: 542367 - RNA, 32 nt, Human
uugggaggccgagacggguggaucacgagguc

SEQ ID NO: 542368 - RNA, 32 nt, Human
uugggaggccgagauagguggaucaccugaag

SEQ ID NO: 542369 - RNA, 32 nt, Human
uugggaggccgagaugggugaaucaugagguc

SEQ ID NO: 542370 - RNA, 32 nt, Human
uugggaggccgagauggguggaucaccugagg

SEQ ID NO: 542371 - RNA, 32 nt, Human
uugggaggccgagauggguggaucaugagguc

SEQ ID NO: 542372 - RNA, 32 nt, Human
uugggaggccgagccaaguggaucacuugagg

SEQ ID NO: 542373 - RNA, 32 nt, Human
uugggaggccgaggagggcagaucaucugagg

SEQ ID NO: 542374 - RNA, 32 nt, Human
uugggaggccgaggagggugaaucaugagauc

SEQ ID NO: 542375 - RNA, 32 nt, Human
uugggaggccgaggaggguggaucacgagguc

SEQ ID NO: 542376 - RNA, 32 nt, Human
uugggaggccgaggaggguggaucaugagguc

SEQ ID NO: 542377 - RNA, 32 nt, Human
uugggaggccgaggcagacagaucaccugagg

SEQ ID NO: 542378 - RNA, 32 nt, Human
uugggaggccgaggcagauggaucacgagguc

SEQ ID NO: 542379 - RNA, 32 nt, Human
uugggaggccgaggcaggaagaucauugagcu

SEQ ID NO: 542380 - RNA, 32 nt, Human
uugggaggccgaggcaggagaaucgcuugaac

SEQ ID NO: 542381 - RNA, 32 nt, Human
uugggaggccgaggcaggagaaucgcuugagc

SEQ ID NO: 542382 - RNA, 32 nt, Human
uugggaggccgaggcaggagaaucucuugaac

SEQ ID NO: 542383 - RNA, 32 nt, Human
uugggaggccgaggcaggagaauugcuugaac

SEQ ID NO: 542384 - RNA, 32 nt, Human
uugggaggccgaggcaggaggaucaccugagg

SEQ ID NO: 542385 - RNA, 32 nt, Human
uugggaggccgaggcaggaggaucacuugagg

SEQ ID NO: 542386 - RNA, 32 nt, Human
uugggaggccgaggcaggcagaucacaagguc

SEQ ID NO: 542387 - RNA, 32 nt, Human
uugggaggccgaggcaggcagaucaccugagg

SEQ ID NO: 542388 - RNA, 32 nt, Human
uugggaggccgaggcaggcagaucaccuuagg

SEQ ID NO: 542389 - RNA, 32 nt, Human
uugggaggccgaggcaggcagaucacgagguc

SEQ ID NO: 542390 - RNA, 32 nt, Human
uugggaggccgaggcaggcagaucacgggguc

SEQ ID NO: 542391 - RNA, 32 nt, Human
uugggaggccgaggcaggcagaucacuugaac

SEQ ID NO: 542392 - RNA, 32 nt, Human
uugggaggccgaggcaggcagaucacuugagg

SEQ ID NO: 542393 - RNA, 32 nt, Human
uugggaggccgaggcaggcaggucacuugagg

SEQ ID NO: 542394 - RNA, 32 nt, Human
uugggaggccgaggcaggcggaucacaagguc

SEQ ID NO: 542395 - RNA, 32 nt, Human
uugggaggccgaggcaggcggaucacaugagg

SEQ ID NO: 542396 - RNA, 32 nt, Human
uugggaggccgaggcaggcggaucaccugaaa

SEQ ID NO: 542397 - RNA, 32 nt, Human
uugggaggccgaggcaggcggaucaccugaga

SEQ ID NO: 542398 - RNA, 32 nt, Human
uugggaggccgaggcaggcggaucaccugagg

SEQ ID NO: 542399 - RNA, 32 nt, Human
uugggaggccgaggcaggcggaucaccuuagg

SEQ ID NO: 542400 - RNA, 32 nt, Human
uugggaggccgaggcaggcggaucacgagguc

SEQ ID NO: 542401 - RNA, 32 nt, Human
uugggaggccgaggcaggcggaucacuugagg

SEQ ID NO: 542402 - RNA, 32 nt, Human
uugggaggccgaggcaggcggaucaugagguc

SEQ ID NO: 542403 - RNA, 32 nt, Human
uugggaggccgaggcaggcggaucaugugguc

SEQ ID NO: 542404 - RNA, 32 nt, Human
uugggaggccgaggcaggcggaucauuugaag

SEQ ID NO: 542405 - RNA, 32 nt, Human
uugggaggccgaggcaggcggaucccgagguc

SEQ ID NO: 542406 - RNA, 32 nt, Human
uugggaggccgaggcaggcggauuaccugagg

SEQ ID NO: 542407 - RNA, 32 nt, Human
uugggaggccgaggcaggcggauuaccuuagg

SEQ ID NO: 542408 - RNA, 32 nt, Human
uugggaggccgaggcaggcugaucacgagguc

SEQ ID NO: 542409 - RNA, 32 nt, Human
uugggaggccgaggcagggggaucaccugagg

SEQ ID NO: 542410 - RNA, 32 nt, Human
uugggaggccgaggcagguagaucaugagguc

SEQ ID NO: 542411 - RNA, 32 nt, Human
uugggaggccgaggcagguggaucaagagguc

SEQ ID NO: 542412 - RNA, 32 nt, Human
uugggaggccgaggcagguggaucacaagauc

SEQ ID NO: 542413 - RNA, 32 nt, Human
uugggaggccgaggcagguggaucacaagguc

SEQ ID NO: 542414 - RNA, 32 nt, Human
uugggaggccgaggcagguggaucacaagguu

SEQ ID NO: 542415 - RNA, 32 nt, Human
uugggaggccgaggcagguggaucacaaguuc

SEQ ID NO: 542416 - RNA, 32 nt, Human
uugggaggccgaggcagguggaucaccuaagg

SEQ ID NO: 542417 - RNA, 32 nt, Human
uugggaggccgaggcagguggaucaccugaga

SEQ ID NO: 542418 - RNA, 32 nt, Human
uugggaggccgaggcagguggaucaccugagg

SEQ ID NO: 542419 - RNA, 32 nt, Human
uugggaggccgaggcagguggaucacgagguc

SEQ ID NO: 542420 - RNA, 32 nt, Human
uugggaggccgaggcagguggaucacgauguc

SEQ ID NO: 542421 - RNA, 32 nt, Human
uugggaggccgaggcagguggaucacgugagg

SEQ ID NO: 542422 - RNA, 32 nt, Human
uugggaggccgaggcagguggaucacucaagc

SEQ ID NO: 542423 - RNA, 32 nt, Human
uugggaggccgaggcagguggaucacucaagg

SEQ ID NO: 542424 - RNA, 32 nt, Human
uugggaggccgaggcagguggaucacugaggu

SEQ ID NO: 542425 - RNA, 32 nt, Human
uugggaggccgaggcagguggaucacuugagc

SEQ ID NO: 542426 - RNA, 32 nt, Human
uugggaggccgaggcagguggaucacuugagg

SEQ ID NO: 542427 - RNA, 32 nt, Human
uugggaggccgaggcagguggaucauagguca

SEQ ID NO: 542428 - RNA, 32 nt, Human
uugggaggccgaggcagguggaucaugagguc

SEQ ID NO: 542429 - RNA, 32 nt, Human
uugggaggccgaggcagguggaucauuugagg

SEQ ID NO: 542430 - RNA, 32 nt, Human
uugggaggccgaggcagguggauugccugagg

SEQ ID NO: 542431 - RNA, 32 nt, Human
uugugccacugcacuccagccugggcgacaga

SEQ ID NO: 542432 - RNA, 32 nt, Human
uugugccacugcacuccagccugggcgacagu

SEQ ID NO: 542433 - RNA, 32 nt, Human
uugugccacugcacuccagccugggcgauaga

SEQ ID NO: 542434 - RNA, 32 nt, Human
uugugccacugcacuccagccuggguaacaga

SEQ ID NO: 542435 - RNA, 32 nt, Human
uugugccacugcacuccagccuggguaacagu

SEQ ID NO: 542436 - RNA, 32 nt, Human
uugugccacugcacuccagccuggguaagaga

SEQ ID NO: 542437 - RNA, 32 nt, Human
uugugccacugcacuccagccugggugaaaga

SEQ ID NO: 542438 - RNA, 32 nt, Human
uugugccacugcacuccagccugggugacaga

SEQ ID NO: 542439 - RNA, 32 nt, Human
uugugccacugcacuccagccugggugacagc

SEQ ID NO: 542440 - RNA, 32 nt, Human
uugugccacugcacuccagccugggugacagg

SEQ ID NO: 542441 - RNA, 32 nt, Human
uugugccacugcacuccagccugggugacuga

SEQ ID NO: 542442 - RNA, 32 nt, Human
uugugccacugcacuccagccuggguggcaga

SEQ ID NO: 542443 - RNA, 32 nt, Human
uugugccacugcacuccagccuggguuacaga

SEQ ID NO: 542444 - RNA, 32 nt, Human
uugugccacugcacuccagccuuggcaacaag

SEQ ID NO: 542445 - RNA, 32 nt, Human
uugugccacugcacuccagccuuggcaacaca

SEQ ID NO: 542446 - RNA, 32 nt, Human
uugugccacugcacuccagcgugggcaacgga

SEQ ID NO: 542447 - RNA, 32 nt, Human
uugugccacugcacuccagcuggguggcagag

SEQ ID NO: 542448 - RNA, 32 nt, Human
uugugccacugcacuccagcuuggugacagag

SEQ ID NO: 542449 - RNA, 32 nt, Human
uugugccacugcacuccagucuggacaacaga

SEQ ID NO: 542450 - RNA, 32 nt, Human
uugugccacugcacucccgccugggcgacaga

SEQ ID NO: 542451 - RNA, 32 nt, Human
uugugccacugcacucgagccugggugacaga

SEQ ID NO: 542452 - RNA, 32 nt, Human
uugugccacugcacucuagccuagguggcuga

SEQ ID NO: 542453 - RNA, 32 nt, Human
uugugccacugcacucuagccucggugacaga

SEQ ID NO: 542454 - RNA, 32 nt, Human
uugugccacugcacucuagccuggacagcaga

SEQ ID NO: 542455 - RNA, 32 nt, Human
uugugccacugcacucuagccugggcaauaag

SEQ ID NO: 542456 - RNA, 32 nt, Human
uugugccacugcacucuagccugggugacaaa

SEQ ID NO: 542457 - RNA, 32 nt, Human
uugugccacugcacucuagccugggugacaga

SEQ ID NO: 542458 - RNA, 32 nt, Human
uugugccacugcacugcagccugggcgacaau

SEQ ID NO: 542459 - RNA, 32 nt, Human
uugugccacugcacugcagccugggcuacaga

SEQ ID NO: 542460 - RNA, 32 nt, Human
uugugccacugcacugcaggcugggugacaga

SEQ ID NO: 542461 - RNA, 32 nt, Human
uugugccacugcacuucagccugggcgacaga

SEQ ID NO: 542462 - RNA, 32 nt, Human
uugugccacugcacuucagcuugggugacaga

SEQ ID NO: 542463 - RNA, 32 nt, Human
uugugccacugcacuuuucagccugggugcca

SEQ ID NO: 542464 - RNA, 32 nt, Human
uugugccacugcauaccagccuaggugacaga

SEQ ID NO: 542465 - RNA, 32 nt, Human
uugugccacugcauucuagccugggcgauaga

SEQ ID NO: 542466 - RNA, 32 nt, Human
uugugccacugcccuccagccugggugacaga

SEQ ID NO: 542467 - RNA, 32 nt, Human
uugugccacugccuccggccugggcgagagug

SEQ ID NO: 542468 - RNA, 32 nt, Human
uugugccacugcgcuccagccugggcgacaga

SEQ ID NO: 542469 - RNA, 32 nt, Human
uugugccacugcucuccagccugggaggcaca

SEQ ID NO: 542470 - RNA, 32 nt, Human
uugugccacuguacaccagccugggugacaga

SEQ ID NO: 542471 - RNA, 32 nt, Human
uugugccacuguacuccagccaggccacagag

SEQ ID NO: 542472 - RNA, 32 nt, Human
uugugccacuguacuccagccuggaagacaag

SEQ ID NO: 542473 - RNA, 32 nt, Human
uugugccacuguacuccagccuggcccacaga

SEQ ID NO: 542474 - RNA, 32 nt, Human
uugugccacuguacuccagccugggagauaga

SEQ ID NO: 542475 - RNA, 32 nt, Human
uugugccacuguacuccagccugggcgacaga

SEQ ID NO: 542476 - RNA, 32 nt, Human
uugugccacuguacuccagccugggugacaga

SEQ ID NO: 542477 - RNA, 32 nt, Human
uugugccacuguacuccagccuggugacagag

SEQ ID NO: 542478 - RNA, 32 nt, Human
uugugccacuguacugcagccugggugacaga

SEQ ID NO: 542479 - RNA, 32 nt, Human
uugugccacuguauuccauccugggcaacaga

SEQ ID NO: 542480 - RNA, 32 nt, Human
uugugccacuguuuuccagccugggcaauaca

SEQ ID NO: 542481 - RNA, 32 nt, Human
uugugccacuucacuccagccugggugacaaa

SEQ ID NO: 542482 - RNA, 32 nt, Human
uugugccacuucauuccagccugggcgacaga

SEQ ID NO: 542483 - RNA, 32 nt, Human
uugugccacuucccuccagccugggcaauaga

SEQ ID NO: 542484 - RNA, 32 nt, Human
uugugccagagccacagaagugugcuugguga

SEQ ID NO: 542485 - RNA, 32 nt, Human
uugugccaggagccucgcagggguugauggga

SEQ ID NO: 542486 - RNA, 32 nt, Human
uugugccaggaggugggguaugcggccaccag

SEQ ID NO: 542487 - RNA, 32 nt, Human
uugugccagugcacuccaggcuggacgacaga

SEQ ID NO: 542488 - RNA, 32 nt, Human
uugugccagugcacuccggccugggugacaga

SEQ ID NO: 542489 - RNA, 32 nt, Human
uugugccaguggguguugucauggcccauguc

SEQ ID NO: 542490 - RNA, 32 nt, Human
uugugccauugcacuacagccuggucaacaga

SEQ ID NO: 542491 - RNA, 32 nt, Human
uugugccauugcacuccaaccugggcaacaag

SEQ ID NO: 542492 - RNA, 32 nt, Human
uugugccauugcacuccagccuggacaacaag

SEQ ID NO: 542493 - RNA, 32 nt, Human
uugugccauugcacuccagccugggcaacaag

SEQ ID NO: 542494 - RNA, 32 nt, Human
uugugccauugcacuccagccugggcaacaga

SEQ ID NO: 542495 - RNA, 32 nt, Human
uugugccauugcacuccagccugggcaacgag

SEQ ID NO: 542496 - RNA, 32 nt, Human
uugugccauugcacuccagccugggcgacaag

SEQ ID NO: 542497 - RNA, 32 nt, Human
uugugccauugcacuccagccugggcgacaga

SEQ ID NO: 542498 - RNA, 32 nt, Human
uugugccauugcacuccagccugggcgacagu

SEQ ID NO: 542499 - RNA, 32 nt, Human
uugugccauugcacuccagccugggcuacaag

SEQ ID NO: 542500 - RNA, 32 nt, Human
uugugccauugcacuccagccugggugacaga

SEQ ID NO: 542501 - RNA, 32 nt, Human
uugugccauugcacuccagccugggugauaag

SEQ ID NO: 542502 - RNA, 32 nt, Human
uugugccauugcacucuagccugggcaacagg

SEQ ID NO: 542503 - RNA, 32 nt, Human
uugugccauugcacugcagccuggaugacaga

SEQ ID NO: 542504 - RNA, 32 nt, Human
uugugccauuggcugcucuuucuaguccccua

SEQ ID NO: 542505 - RNA, 32 nt, Human
uugugccauuguacuccagccugggcgacaaa

SEQ ID NO: 542506 - RNA, 28 nt, Human
uugugcccaaguguuucccucucucccu

SEQ ID NO: 542507 - RNA, 24 nt, Human
uugugcccaccagucagauccugu

SEQ ID NO: 542508 - RNA, 31 nt, Human
uugugcccacugugugggccuguguuguguc

SEQ ID NO: 542509 - RNA, 32 nt, Human
uugugcccagaaguuugaggcugcagugagcc

SEQ ID NO: 542510 - RNA, 32 nt, Human
uugugcccaggaguucaagaccagccugggca

SEQ ID NO: 542511 - RNA, 23 nt, Human
uugugcccaggcuggagugcaau

SEQ ID NO: 542512 - RNA, 32 nt, Human
uugugcccagggguugcaggcugcagugagcu

SEQ ID NO: 542513 - RNA, 28 nt, Human
uugugcccaggugcugcccacuccugau

SEQ ID NO: 542514 - RNA, 32 nt, Human
uugugcccaugggcuguggcguaugucagauc

SEQ ID NO: 542515 - RNA, 32 nt, Human
uugugcccauuaggaagcugauugcuuacggg

SEQ ID NO: 542516 - RNA, 18 nt, Human
uugugcccauuccuaaua

SEQ ID NO: 542517 - RNA, 32 nt, Human
uugugccccugcacuccagccugagcgacagu

SEQ ID NO: 542518 - RNA, 32 nt, Human
uugugccccugcauucuagccugggugacagu

SEQ ID NO: 542519 - RNA, 32 nt, Human
uugugccccugccuaggugccugugcugggug

SEQ ID NO: 542520 - RNA, 32 nt, Human
uugugcccgcucuggacuuuugcccauagugg

SEQ ID NO: 542521 - RNA, 32 nt, Human
uugugcccuagacuggagugcaauggcgccau

SEQ ID NO: 542522 - RNA, 32 nt, Human
uugugcccugcucuucagcaccaugggccuuc

SEQ ID NO: 542523 - RNA, 32 nt, Human
uugugcccuggaccucgggcacagcugucagc

SEQ ID NO: 542524 - RNA, 32 nt, Human
uugugccgcaaccaccucagccuggaugacgg

SEQ ID NO: 542525 - RNA, 32 nt, Human
uugugccgcugcacuccagccuggcgacaaag

SEQ ID NO: 542526 - RNA, 32 nt, Human
uugugccuaggaguucgaggcugcagugggcu

SEQ ID NO: 542527 - RNA, 22 nt, Human
uugugccuauuuccuccaaguc

SEQ ID NO: 542528 - RNA, 32 nt, Human
uugugccucacacuccagccuggguaacagag

SEQ ID NO: 542529 - RNA, 32 nt, Human
uugugccuccacugaugcaggagcugccaccc

SEQ ID NO: 542530 - RNA, 32 nt, Human
uugugccucccauccaugcacaggagggacug

SEQ ID NO: 542531 - RNA, 32 nt, Human
uugugccucucagauugcugaagugcugcugg

SEQ ID NO: 542532 - RNA, 32 nt, Human
uugugccucuuuguuuuuccccaaaccaaagc

SEQ ID NO: 542533 - RNA, 32 nt, Human
uugugccugaaaucccagcuaucaggaggcug

SEQ ID NO: 542534 - RNA, 32 nt, Human
uugugccugauaccugcacuccggcuuccuag

SEQ ID NO: 542535 - RNA, 20 nt, Human
uugugccugcccagagccug

SEQ ID NO: 542536 - RNA, 32 nt, Human
uugugccugccugugcagagggagaggcccug

SEQ ID NO: 542537 - RNA, 32 nt, Human
uugugccugcuuucgagggccuccuggacuca

SEQ ID NO: 542538 - RNA, 32 nt, Human
uugugccuggagcugcucuccuggccuccuug

SEQ ID NO: 542539 - RNA, 32 nt, Human
uugugccuggcuucuuucucucagccuuacau

SEQ ID NO: 542540 - RNA, 32 nt, Human
uugugccugggggagcguggaggcagggccuc

SEQ ID NO: 542541 - RNA, 32 nt, Human
uugugccuguaaucccagaacuuuggaaggcc

SEQ ID NO: 542542 - RNA, 32 nt, Human
uugugccuguaaucccagcuacuugggaggcu

SEQ ID NO: 542543 - RNA, 32 nt, Human
uugugccuguaauuccagcugcucuggaagcc

SEQ ID NO: 542544 - RNA, 32 nt, Human
uugugccuguagucccagcuacuugggaggcu

SEQ ID NO: 542545 - RNA, 19 nt, Human
uugugccuguaugauauca

SEQ ID NO: 542546 - RNA, 32 nt, Human
uugugccugucugcgccucucacacacagaua

SEQ ID NO: 542547 - RNA, 32 nt, Human
uugugccuguuucucuuauccuuucccgacau

SEQ ID NO: 542548 - RNA, 32 nt, Human
uugugccuugcacuccaugcauucugauaacg

SEQ ID NO: 542549 - RNA, 32 nt, Human
uugugccuuggugacugucaaauaaaagcaag

SEQ ID NO: 542550 - RNA, 19 nt, Human
uugugccuuuccuuucuca

SEQ ID NO: 542551 - RNA, 32 nt, Human
uugugccuuuuaggagcuuuauguuuagaaac

SEQ ID NO: 542552 - RNA, 32 nt, Human
uugugcgaggaggugaaggccacagugaccca

SEQ ID NO: 542553 - RNA, 32 nt, Human
uugugcgcugggaggcgcaucugcagcacuua

SEQ ID NO: 542554 - RNA, 32 nt, Human
uugugcgggcgggagggcaaugguggcagaga

SEQ ID NO: 542555 - RNA, 32 nt, Human
uugugcuacugcacuccaaucuggcaacagag

SEQ ID NO: 542556 - RNA, 32 nt, Human
uugugcuacugcacucuagauugggugacaga

SEQ ID NO: 542557 - RNA, 32 nt, Human
uugugcuauguggagcucacagccucacaugu

SEQ ID NO: 542558 - RNA, 32 nt, Human
uugugcuauugcacuccagccugggugacaga

SEQ ID NO: 542559 - RNA, 32 nt, Human
uugugcucaagugauucucccaucucagccuc

SEQ ID NO: 542560 - RNA, 19 nt, Human
uugugcucagcgcuaccug

SEQ ID NO: 542561 - RNA, 32 nt, Human
uugugcucaggccagagacuugcucacuuccu

SEQ ID NO: 542562 - RNA, 32 nt, Human
uugugcucaucagagaccccagccuggggaac

SEQ ID NO: 542563 - RNA, 32 nt, Human
uugugcuccagccugggcaacaagagugaaac

SEQ ID NO: 542564 - RNA, 32 nt, Human
uugugcuccagccugggcaacagagugagacu

SEQ ID NO: 542565 - RNA, 32 nt, Human
uugugcucccaaagugcugagauuacaggcgu

SEQ ID NO: 542566 - RNA, 32 nt, Human
uugugcucccacugcaucagacugcuuccauc

SEQ ID NO: 542567 - RNA, 32 nt, Human
uugugcuccucuugauuccugguuugacucag

SEQ ID NO: 542568 - RNA, 32 nt, Human
uugugcucuaaagagcggaccccagccucugc

SEQ ID NO: 542569 - RNA, 32 nt, Human
uugugcucugcagccuuuuucuucugaaaggc

SEQ ID NO: 542570 - RNA, 32 nt, Human
uugugcucuuugucauggcaaccagcuucuga

SEQ ID NO: 542571 - RNA, 32 nt, Human
uugugcugacacaccugccuguccaccccuca

SEQ ID NO: 542572 - RNA, 32 nt, Human
uugugcugcugcacuccagccugggagacaga

SEQ ID NO: 542573 - RNA, 32 nt, Human
uugugcugcugcacuccagccugggugaaaaa

SEQ ID NO: 542574 - RNA, 32 nt, Human
uugugcugggagaccggacccggggcugcaga

SEQ ID NO: 542575 - RNA, 32 nt, Human
uugugcugucucccucucccacccgugucugc

SEQ ID NO: 542576 - RNA, 32 nt, Human
uugugcugucuuccugugaccagcagauccug

SEQ ID NO: 542577 - RNA, 32 nt, Human
uugugcugugauguuucagggagcuugguggu

SEQ ID NO: 542578 - RNA, 32 nt, Human
uugugcuguggggaagggagaaggauuuguaa

SEQ ID NO: 542579 - RNA, 32 nt, Human
uugugcuguggggcugguagcucaggugggcg

SEQ ID NO: 542580 - RNA, 32 nt, Human
uugugcuguguucgugucuugcacuggaauuc

SEQ ID NO: 542581 - RNA, 32 nt, Human
uugugcuguucggcucuugaaucccagcgaug

SEQ ID NO: 542582 - RNA, 32 nt, Human
uugugcuuagcuuucagauuauggaugauuaa

SEQ ID NO: 542583 - RNA, 32 nt, Human
uugugcuuaguauuuaaaccugaacauugaaa

SEQ ID NO: 542584 - RNA, 32 nt, Human
uugugcuuaguccaauuccuugcacauaguag

SEQ ID NO: 542585 - RNA, 32 nt, Human
uugugcuuucauuuucuuaaugacuuuuaccu

SEQ ID NO: 542586 - RNA, 32 nt, Human
uugugcuuuugaaaagaguauacuuuuuacuu

SEQ ID NO: 542587 - RNA, 32 nt, Human
uugugcuuuuucuccccuccucuauuccuuuu

SEQ ID NO: 542588 - RNA, 32 nt, Human
uuguggaaagugaaggagcccuggagagcugg

SEQ ID NO: 542589 - RNA, 32 nt, Human
uuguggaauugacucaaaaaugagguacuuca

SEQ ID NO: 542590 - RNA, 32 nt, Human
uuguggacugguugguggaggugcaggugucc

SEQ ID NO: 542591 - RNA, 32 nt, Human
uuguggacuucacauggucaugcaggaaguga

SEQ ID NO: 542592 - RNA, 32 nt, Human
uuguggagaagcgaagggcugaggggagguuu

SEQ ID NO: 542593 - RNA, 32 nt, Human
uuguggagaaggaagcauucuuuaggcugcgg

SEQ ID NO: 542594 - RNA, 32 nt, Human
uuguggagaagguagcccaggagcagggcggc

SEQ ID NO: 542595 - RNA, 32 nt, Human
uuguggagacaaggucucuccauguugccuag

SEQ ID NO: 542596 - RNA, 32 nt, Human
uuguggagagagccccuaaaauggagccuggc

SEQ ID NO: 542597 - RNA, 32 nt, Human
uuguggagaugggguuucaccauguugccaag

SEQ ID NO: 542598 - RNA, 32 nt, Human
uuguggagaugggguuucaccauguuggccag

SEQ ID NO: 542599 - RNA, 32 nt, Human
uuguggagaugggguuucacuauguugccuaa

SEQ ID NO: 542600 - RNA, 32 nt, Human
uuguggagaugggguuucaucauguuggccag

SEQ ID NO: 542601 - RNA, 32 nt, Human
uuguggagcugggggaagaaaccugcaauaug

SEQ ID NO: 542602 - RNA, 32 nt, Human
uuguggagcugucaucagcucagcuuuaacaa

SEQ ID NO: 542603 - RNA, 32 nt, Human
uuguggagguuuuguuggugugcaauggagga

SEQ ID NO: 542604 - RNA, 32 nt, Human
uuguggagugccucucucuaggacggggcugc

SEQ ID NO: 542605 - RNA, 32 nt, Human
uuguggauacauaucaaaugcuguaauauauu

SEQ ID NO: 542606 - RNA, 32 nt, Human
uuguggauagacugaaaugcaccaccaaggcc

SEQ ID NO: 542607 - RNA, 32 nt, Human
uuguggaucacugacauggucaggggaggccc

SEQ ID NO: 542608 - RNA, 21 nt, Human
uuguggauccaccacacccca

SEQ ID NO: 542609 - RNA, 32 nt, Human
uuguggauccaccacaccccaccgagcacuag

SEQ ID NO: 542610 - RNA, 32 nt, Human
uuguggaugagagacucacacccagucccugg

SEQ ID NO: 542611 - RNA, 32 nt, Human
uuguggaugagcugcaggugcagugacuccag

SEQ ID NO: 542612 - RNA, 32 nt, Human
uuguggaugagcugcaggugcagugcuccagc

SEQ ID NO: 542613 - RNA, 32 nt, Human
uuguggaugcuggccauggugggcaggcgccu

SEQ ID NO: 542614 - RNA, 32 nt, Human
uuguggauguacaguauaagcaucuaauucaa

SEQ ID NO: 542615 - RNA, 22 nt, Human
uuguggauuucacaucacucca

SEQ ID NO: 542616 - RNA, 32 nt, Human
uuguggcaagugacaaagauagcuguaugcuc

SEQ ID NO: 542617 - RNA, 32 nt, Human
uuguggcaaucaaagggguggaaagugaauuc

SEQ ID NO: 542618 - RNA, 32 nt, Human
uuguggcacugcacuccagucugggugacaga

SEQ ID NO: 542619 - RNA, 32 nt, Human
uuguggcacugccucccuugucucuccagccu

SEQ ID NO: 542620 - RNA, 32 nt, Human
uuguggcagcugagccacugaggccagccucg

SEQ ID NO: 542621 - RNA, 32 nt, Human
uuguggcaggcccugguggcagcugggcuggu

SEQ ID NO: 542622 - RNA, 32 nt, Human
uuguggcagucugaacgcccccagaaaauugu

SEQ ID NO: 542623 - RNA, 32 nt, Human
uuguggcaugcucuuugggagcugcacaguua

SEQ ID NO: 542624 - RNA, 32 nt, Human
uuguggcauugcacuccagccugggugguaga

SEQ ID NO: 542625 - RNA, 32 nt, Human
uuguggcauuuuccuguauugucuuggacaug

SEQ ID NO: 542626 - RNA, 32 nt, Human
uuguggcauuuuuccuugccuuccucggaggg

SEQ ID NO: 542627 - RNA, 32 nt, Human
uuguggccaagaggcuuccuggcauccacccc

SEQ ID NO: 542628 - RNA, 32 nt, Human
uuguggccauguaccgcuaccugggcgaagcg

SEQ ID NO: 542629 - RNA, 19 nt, Human
uuguggccgggugcagugg

SEQ ID NO: 542630 - RNA, 32 nt, Human
uuguggccgguuuucuccgcagguugaacaug

SEQ ID NO: 542631 - RNA, 32 nt, Human
uuguggccuguaaucccagcuacucgggaggc

SEQ ID NO: 542632 - RNA, 32 nt, Human
uuguggcgggagcagaggacagcgagguucag

SEQ ID NO: 542633 - RNA, 32 nt, Human
uuguggcgucacugcacuguuaccccgcccua

SEQ ID NO: 542634 - RNA, 32 nt, Human
uuguggcucacugcaaacuccacuucccuagu

SEQ ID NO: 542635 - RNA, 32 nt, Human
uuguggcucccccucuggaggagguggcucca

SEQ ID NO: 542636 - RNA, 32 nt, Human
uuguggcucuuauuucugaauucaaagcuugu

SEQ ID NO: 542637 - RNA, 32 nt, Human
uuguggcuggcuucccuuucugucugcuauug

SEQ ID NO: 542638 - RNA, 32 nt, Human
uuguggcuggucuccuggugucaguguucucu

SEQ ID NO: 542639 - RNA, 32 nt, Human
uuguggcuguaaagcuguagcagcucagguag

SEQ ID NO: 542640 - RNA, 32 nt, Human
uuguggcugugccaggaguacaugugagacua

SEQ ID NO: 542641 - RNA, 32 nt, Human
uuguggcuuccaccagcccuaauggagugcuc

SEQ ID NO: 542642 - RNA, 32 nt, Human
uuguggcuuccuaaaauucaguggaaaauuaa

SEQ ID NO: 542643 - RNA, 32 nt, Human
uugugggaaacugaggcccagcuuggggaagg

SEQ ID NO: 542644 - RNA, 32 nt, Human
uugugggaaagacagaggcgggaggauugagu

SEQ ID NO: 542645 - RNA, 32 nt, Human
uugugggaaccacagaugguugggguugaaca

SEQ ID NO: 542646 - RNA, 32 nt, Human
uugugggaagacagggugaauuuaucacagag

SEQ ID NO: 542647 - RNA, 32 nt, Human
uugugggaagagggagguuccaccgcaccccu

SEQ ID NO: 542648 - RNA, 32 nt, Human
uugugggaagagggugcagcacuggaccccuu

SEQ ID NO: 542649 - RNA, 32 nt, Human
uugugggaaggcacuccucuuggcauuugcuu

SEQ ID NO: 542650 - RNA, 32 nt, Human
uugugggacuuuaccaaaucgguuuguaauaa

SEQ ID NO: 542651 - RNA, 32 nt, Human
uugugggaggccuuggugauucggccacagcc

SEQ ID NO: 542652 - RNA, 32 nt, Human
uugugggagggugggcagggaggggucccaga

SEQ ID NO: 542653 - RNA, 32 nt, Human
uugugggcaaaagagaaaaagaaggauugauc

SEQ ID NO: 542654 - RNA, 32 nt, Human
uugugggcacacugccuauggguagcccugcu

SEQ ID NO: 542655 - RNA, 32 nt, Human
uugugggcagccagcaccucuaccuguuccuc

SEQ ID NO: 542656 - RNA, 32 nt, Human
uugugggcagcugcaggccccaugccucuccu

SEQ ID NO: 542657 - RNA, 31 nt, Human
uugugggcaguguccagacagaagaagagac

SEQ ID NO: 542658 - RNA, 32 nt, Human
uugugggcauugcucuaaccuacuucucaagc

SEQ ID NO: 542659 - RNA, 32 nt, Human
uugugggccggccuugggggagggggacgcgc

SEQ ID NO: 542660 - RNA, 20 nt, Human
uugugggccgggcgcagugg

SEQ ID NO: 542661 - RNA, 32 nt, Human
uugugggcucaaauauuuggucaugggggaag

SEQ ID NO: 542662 - RNA, 32 nt, Human
uuguggggaaaaggaaagaugggggacacuuc

SEQ ID NO: 542663 - RNA, 32 nt, Human
uuguggggagguggcuucagaggcucacaagc

SEQ ID NO: 542664 - RNA, 32 nt, Human
uuguggggccugggcuucugugguuuaaggga

SEQ ID NO: 542665 - RNA, 32 nt, Human
uuguggggcucaauaaauggcucugugaacuu

SEQ ID NO: 542666 - RNA, 32 nt, Human
uuguggggcuucuguuccgcugggggagacag

SEQ ID NO: 542667 - RNA, 32 nt, Human
uugugggggaggugugggggcaguguccaucc

SEQ ID NO: 542668 - RNA, 32 nt, Human
uugugggguggagggaggaagggcugggaggg

SEQ ID NO: 542669 - RNA, 32 nt, Human
uugugggguuguggagguugugggggcggugg

SEQ ID NO: 542670 - RNA, 32 nt, Human
uugugggguuuuucuguauuagcuuaugaacu

SEQ ID NO: 542671 - RNA, 31 nt, Human
uugugggucacacucuuuacauuucuguaag

SEQ ID NO: 542672 - RNA, 32 nt, Human
uugugggucaucuugcaccuuuacaaacaagg

SEQ ID NO: 542673 - RNA, 32 nt, Human
uugugggucaugcugggaaguggcccggcugc

SEQ ID NO: 542674 - RNA, 32 nt, Human
uugugggucucugucuuuuucucccaguggca

SEQ ID NO: 542675 - RNA, 32 nt, Human
uugugggucuuucuguucccaagauccugaac

SEQ ID NO: 542676 - RNA, 32 nt, Human
uugugggugaagccagggagggagacaggagg

SEQ ID NO: 542677 - RNA, 32 nt, Human
uugugggugagaaucuauguacauauaauaug

SEQ ID NO: 542678 - RNA, 32 nt, Human
uugugggugagggucgagggccaccgaggucc

SEQ ID NO: 542679 - RNA, 32 nt, Human
uugugggugaugaucacugugcugcuuguggc

SEQ ID NO: 542680 - RNA, 32 nt, Human
uugugggugggugggcugaauggggaggaaau

SEQ ID NO: 542681 - RNA, 32 nt, Human
uuguggguguccccacuggaguguaagcccua

SEQ ID NO: 542682 - RNA, 26 nt, Human
uugugguacgcaggcuggagugcagu

SEQ ID NO: 542683 - RNA, 32 nt, Human
uugugguauuuuuaguagagacaggguuucac

SEQ ID NO: 542684 - RNA, 32 nt, Human
uuguggucaccaacuguccuaaaaagauuugg

SEQ ID NO: 542685 - RNA, 32 nt, Human
uuguggucacuagcuucaguccuucuggauug

SEQ ID NO: 542686 - RNA, 32 nt, Human
uuguggucacucacucacccugacccugggca

SEQ ID NO: 542687 - RNA, 32 nt, Human
uugugguccugccucuuuucuaagcauauggc

SEQ ID NO: 542688 - RNA, 32 nt, Human
uuguggucuaugaguuuacaauacugcaaacu

SEQ ID NO: 542689 - RNA, 32 nt, Human
uuguggucuuccuaugugucagaaacaacugu

SEQ ID NO: 542690 - RNA, 32 nt, Human
uuguggugagacugaauuuugggcucagacac

SEQ ID NO: 542691 - RNA, 32 nt, Human
uuguggugcugacaaagcuuggaagagccugc

SEQ ID NO: 542692 - RNA, 32 nt, Human
uugugguggaggugauuugggauagacuaggu

SEQ ID NO: 542693 - RNA, 32 nt, Human
uuguggugggcccugaguccugguuuccuggc

SEQ ID NO: 542694 - RNA, 32 nt, Human
uuguggugugagauguuccuggaacucagcca

SEQ ID NO: 542695 - RNA, 32 nt, Human
uugugguucccaaugugucugucccacccuga

SEQ ID NO: 542696 - RNA, 32 nt, Human
uugugguucuuggggccuuccucuuuguuucu

SEQ ID NO: 542697 - RNA, 32 nt, Human
uugugguugagggaaggacaagagauaagagg

SEQ ID NO: 542698 - RNA, 32 nt, Human
uugugguugcagcuguuuucgugucauguaua

SEQ ID NO: 542699 - RNA, 32 nt, Human
uugugguuguugcccaggcuggagugcagugg

SEQ ID NO: 542700 - RNA, 32 nt, Human
uugugguuuaaggagaauaaaguugacuacau

SEQ ID NO: 542701 - RNA, 32 nt, Human
uugugguuuccucuuuaagacagggucuugcu

SEQ ID NO: 542702 - RNA, 19 nt, Human
uugugguuucucugaguca

SEQ ID NO: 542703 - RNA, 32 nt, Human
uuguguaaaccagaccccuuguccucaugacc

SEQ ID NO: 542704 - RNA, 32 nt, Human
uuguguaacauacuuccaccagcaguccaaca

SEQ ID NO: 542705 - RNA, 32 nt, Human
uuguguaacugaaucuugugcuucauuuccuu

SEQ ID NO: 542706 - RNA, 32 nt, Human
uuguguaagacaguaacuuuacacuucagaca

SEQ ID NO: 542707 - RNA, 32 nt, Human
uuguguaaguucauacuuggucugagccacug

SEQ ID NO: 542708 - RNA, 32 nt, Human
uuguguaauauauuguacacuacagcaucuua

SEQ ID NO: 542709 - RNA, 32 nt, Human
uuguguaauugagcuguaacccagggacagga

SEQ ID NO: 542710 - RNA, 32 nt, Human
uuguguacaccaugcccauguauauacaagua

SEQ ID NO: 542711 - RNA, 32 nt, Human
uuguguacccuucacccagccucccccaaugg

SEQ ID NO: 542712 - RNA, 32 nt, Human
uuguguacuuucacaaacaaaggcuuagaauu

SEQ ID NO: 542713 - RNA, 32 nt, Human
uuguguagacugcagacauccauaccucacca

SEQ ID NO: 542714 - RNA, 32 nt, Human
uuguguaggugagagaaagagggaggagugag

SEQ ID NO: 542715 - RNA, 32 nt, Human
uuguguaguaagcaccuuuguucauacuagua

SEQ ID NO: 542716 - RNA, 32 nt, Human
uuguguauacuucugugucuguuauguucaau

SEQ ID NO: 542717 - RNA, 32 nt, Human
uuguguauagaagaagcuggugagagugcccu

SEQ ID NO: 542718 - RNA, 32 nt, Human
uuguguaucaguucucuaacacuuguuccuga

SEQ ID NO: 542719 - RNA, 32 nt, Human
uuguguauccguaauaauguccuugaagucag

SEQ ID NO: 542720 - RNA, 32 nt, Human
uuguguaucuguccuguuagaaguagaugacu

SEQ ID NO: 542721 - RNA, 32 nt, Human
uuguguaucuuuggacaauuagauggacauuu

SEQ ID NO: 542722 - RNA, 32 nt, Human
uuguguaugacagcuuuccuucacacacuauu

SEQ ID NO: 542723 - RNA, 32 nt, Human
uuguguauggaaggcggggcucauggcugauu

SEQ ID NO: 542724 - RNA, 32 nt, Human
uuguguauguuauuucuggaagcauguuaggu

SEQ ID NO: 542725 - RNA, 32 nt, Human
uuguguauguuauuugccaaagacagauauaa

SEQ ID NO: 542726 - RNA, 32 nt, Human
uugugucaaauagaaagguacuguaggcagug

SEQ ID NO: 542727 - RNA, 32 nt, Human
uugugucaacuucuaagccaaaguuugggaau

SEQ ID NO: 542728 - RNA, 32 nt, Human
uugugucacaguucacugcagccugggugaca

SEQ ID NO: 542729 - RNA, 32 nt, Human
uugugucacccaggcuggagugcaauggcgca

SEQ ID NO: 542730 - RNA, 32 nt, Human
uugugucacccaggcuggcgugcagggcccug

SEQ ID NO: 542731 - RNA, 32 nt, Human
uugugucacccagguuagaguguaguggcgcc

SEQ ID NO: 542732 - RNA, 32 nt, Human
uugugucacugcacuccagccugggcaacagg

SEQ ID NO: 542733 - RNA, 32 nt, Human
uugugucacugcacuccagcuugggugacaga

SEQ ID NO: 542734 - RNA, 32 nt, Human
uugugucaggggcugccagccuccuuuuguuu

SEQ ID NO: 542735 - RNA, 31 nt, Human
uugugucaguuucagauccugaucuuaagag

SEQ ID NO: 542736 - RNA, 32 nt, Human
uugugucaucuucuuaccaugaucaaaggcga

SEQ ID NO: 542737 - RNA, 32 nt, Human
uugugucauucuuacauuccucuccuucucag

SEQ ID NO: 542738 - RNA, 32 nt, Human
uugugucauugcacuccagccugggcaacaag

SEQ ID NO: 542739 - RNA, 32 nt, Human
uugugucauugcacuccagccuggggaacaga

SEQ ID NO: 542740 - RNA, 23 nt, Human
uuguguccaggcuggagugcagu

SEQ ID NO: 542741 - RNA, 24 nt, Human
uuguguccaggcuggagugcagug

SEQ ID NO: 542742 - RNA, 32 nt, Human
uuguguccaucugcuuugaccugggcauuaga

SEQ ID NO: 542743 - RNA, 32 nt, Human
uuguguccccuaaaaaguggcucugcuucaga

SEQ ID NO: 542744 - RNA, 32 nt, Human
uuguguccuccaggagcuucuuguuuccuugu

SEQ ID NO: 542745 - RNA, 32 nt, Human
uuguguccugcagguaucugcagauuuauggc

SEQ ID NO: 542746 - RNA, 32 nt, Human
uuguguccugcucuguuuggugggccauaugc

SEQ ID NO: 542747 - RNA, 32 nt, Human
uugugucgaagccccagugcucugccuggaaa

SEQ ID NO: 542748 - RNA, 32 nt, Human
uugugucgccuuuggugggccauguccuaauu

SEQ ID NO: 542749 - RNA, 32 nt, Human
uugugucuaauacuugaccuguccugcuguuu

SEQ ID NO: 542750 - RNA, 32 nt, Human
uugugucuacacaucggggugaccuuagguca

SEQ ID NO: 542751 - RNA, 32 nt, Human
uugugucuacacaucggggugaccuuaggucg

SEQ ID NO: 542752 - RNA, 32 nt, Human
uugugucuacagccacugaauccuguccuaca

SEQ ID NO: 542753 - RNA, 19 nt, Human
uugugucuauugaaaguau

SEQ ID NO: 542754 - RNA, 19 nt, Human
uugugucucaggaaagcau

SEQ ID NO: 542755 - RNA, 32 nt, Human
uugugucucaucucccugcgugucuuuuccuu

SEQ ID NO: 542756 - RNA, 32 nt, Human
uugugucucauggggguuugguguacaaauaa

SEQ ID NO: 542757 - RNA, 32 nt, Human
uugugucuccacccccuuccauguguugaaua

SEQ ID NO: 542758 - RNA, 32 nt, Human
uugugucucccccaucucauccuuuuccccgg

SEQ ID NO: 542759 - RNA, 32 nt, Human
uugugucuccccucagacugcggcucccugag

SEQ ID NO: 542760 - RNA, 19 nt, Human
uugugucuccuuccuaagc

SEQ ID NO: 542761 - RNA, 19 nt, Human
uugugucucgcuuugagca

SEQ ID NO: 542762 - RNA, 32 nt, Human
uugugucugcagcagaaggccccagccucgug

SEQ ID NO: 542763 - RNA, 32 nt, Human
uugugucugcuaagaagucugauuucugcuca

SEQ ID NO: 542764 - RNA, 32 nt, Human
uugugucugugaugaaaggaacagucugugca

SEQ ID NO: 542765 - RNA, 22 nt, Human
uugugucugugugugacagcau

SEQ ID NO: 542766 - RNA, 32 nt, Human
uugugucuucauuuuaauguguuugcaaucgc

SEQ ID NO: 542767 - RNA, 32 nt, Human
uugugucuucauuuuuccuccugucugcauuc

SEQ ID NO: 542768 - RNA, 32 nt, Human
uugugucuuccagauggguaccacagauggcu

SEQ ID NO: 542769 - RNA, 32 nt, Human
uugugucuuccccuggggaugaggguugggug

SEQ ID NO: 542770 - RNA, 19 nt, Human
uugugucuucuggguccuu

SEQ ID NO: 542771 - RNA, 32 nt, Human
uugugucuugugucaggccuugcccuucccac

SEQ ID NO: 542772 - RNA, 32 nt, Human
uugugucuuucuaaauuucucucuccaaaaua

SEQ ID NO: 542773 - RNA, 32 nt, Human
uugugucuuugcucaagucccaccuccccaag

SEQ ID NO: 542774 - RNA, 32 nt, Human
uugugucuuuugucacaaaacaaugauauuug

SEQ ID NO: 542775 - RNA, 32 nt, Human
uugugugaacaucacagaguguuacuuacaca

SEQ ID NO: 542776 - RNA, 22 nt, Human
uugugugaacucucggcuguuu

SEQ ID NO: 542777 - RNA, 32 nt, Human
uugugugacagaaguagcaaaaucugguccuc

SEQ ID NO: 542778 - RNA, 32 nt, Human
uugugugacagaaguagcaaaaucugguccuu

SEQ ID NO: 542779 - RNA, 32 nt, Human
uugugugauagaauaaaaauauguuaccugca

SEQ ID NO: 542780 - RNA, 32 nt, Human
uugugugauuccauuuccagacagaaagcaga

SEQ ID NO: 542781 - RNA, 32 nt, Human
uugugugcaaaggauggacagaaggacugccu

SEQ ID NO: 542782 - RNA, 32 nt, Human
uugugugcacacauggccucauuggcucucag

SEQ ID NO: 542783 - RNA, 32 nt, Human
uugugugcagugaccacuguugcugccaccau

SEQ ID NO: 542784 - RNA, 32 nt, Human
uugugugcaucuggccuggaacugguguuaag

SEQ ID NO: 542785 - RNA, 32 nt, Human
uugugugcaugaaagagaaagacugauuaccu

SEQ ID NO: 542786 - RNA, 17 nt, Human
uugugugccccacguca

SEQ ID NO: 542787 - RNA, 32 nt, Human
uugugugccuguagguacugugugucacugaa

SEQ ID NO: 542788 - RNA, 32 nt, Human
uugugugccuguagucccagcuacuuaggagg

SEQ ID NO: 542789 - RNA, 32 nt, Human
uugugugcuguugguugugguggaggaugugg

SEQ ID NO: 542790 - RNA, 21 nt, Human
uugugugcuuguuuugcgcua

SEQ ID NO: 542791 - RNA, 32 nt, Human
uuguguggcccaaucugaugggcuguuauaag

SEQ ID NO: 542792 - RNA, 32 nt, Human
uuguguggccuagaaguccucuguggucuccc

SEQ ID NO: 542793 - RNA, 32 nt, Human
uuguguggcugaagaggcaggaggaacagugu

SEQ ID NO: 542794 - RNA, 32 nt, Human
uuguguggcugcaaaacaucacaaagugaccg

SEQ ID NO: 542795 - RNA, 29 nt, Human
uuguguggcugcagugugccugggcccag

SEQ ID NO: 542796 - RNA, 32 nt, Human
uuguguggcuucaaacauuauggagaugucuu

SEQ ID NO: 542797 - RNA, 32 nt, Human
uuguguggggucaggucugacagaagaggagc

SEQ ID NO: 542798 - RNA, 32 nt, Human
uuguguggguggcacagaucugggcaguuaga

SEQ ID NO: 542799 - RNA, 32 nt, Human
uuguguggugggggcagccucugccucaaaaa

SEQ ID NO: 542800 - RNA, 32 nt, Human
uuguguguaccccgcuucugacugccuagggc

SEQ ID NO: 542801 - RNA, 32 nt, Human
uugugugucaugccagugagggacgucagacu

SEQ ID NO: 542802 - RNA, 32 nt, Human
uuguguguccaugcuggagaaaagccuuguua

SEQ ID NO: 542803 - RNA, 32 nt, Human
uugugugucucuguagaaaggcgaaggggcag

SEQ ID NO: 542804 - RNA, 32 nt, Human
uugugugucuucaggagaaugugcagugucuu

SEQ ID NO: 542805 - RNA, 32 nt, Human
uugugugugagagccccacagagcagguguug

SEQ ID NO: 542806 - RNA, 32 nt, Human
uugugugugcucugcuucaauguagucagaau

SEQ ID NO: 542807 - RNA, 31 nt, Human
uuguguguggcugguguaugggugagcaugc

SEQ ID NO: 542808 - RNA, 32 nt, Human
uuguguguuaacuucuagcugccuggggcugg

SEQ ID NO: 542809 - RNA, 32 nt, Human
uuguguuaaagugaauuagugugucagcuuaa

SEQ ID NO: 542810 - RNA, 32 nt, Human
uuguguuaaggcagaaauaauuaggcuagggc

SEQ ID NO: 542811 - RNA, 32 nt, Human
uuguguuaaugccacuucaagucauuauuugg

SEQ ID NO: 542812 - RNA, 32 nt, Human
uuguguuaccauuugaauacacugacuaaugu

SEQ ID NO: 542813 - RNA, 32 nt, Human
uuguguuaccuagcuggcuggguagcagugga

SEQ ID NO: 542814 - RNA, 32 nt, Human
uuguguuacucaucuuuauugucuccaugauu

SEQ ID NO: 542815 - RNA, 32 nt, Human
uuguguuagcagugccugggccugggccucag

SEQ ID NO: 542816 - RNA, 32 nt, Human
uuguguuaguuguaucugaaacuguuauguau

SEQ ID NO: 542817 - RNA, 32 nt, Human
uuguguuaucggacauucuaaugcauauuuau

SEQ ID NO: 542818 - RNA, 32 nt, Human
uuguguuaugccacuacucauguugucuuagg

SEQ ID NO: 542819 - RNA, 32 nt, Human
uuguguuauuucagaauaacuaaaguacuuca

SEQ ID NO: 542820 - RNA, 32 nt, Human
uuguguucacgauauucacuccugcccuccgu

SEQ ID NO: 542821 - RNA, 32 nt, Human
uuguguucagacacacacaucacagcuugacu

SEQ ID NO: 542822 - RNA, 32 nt, Human
uuguguucagggaugguuucauguagccacau

SEQ ID NO: 542823 - RNA, 32 nt, Human
uuguguuccccaggcugaagugcaguggcaug

SEQ ID NO: 542824 - RNA, 32 nt, Human
uuguguucccgugucugucugucuugcauccc

SEQ ID NO: 542825 - RNA, 32 nt, Human
uuguguuccucucccagcuccaucucuuuccc

SEQ ID NO: 542826 - RNA, 23 nt, Human
uuguguuccuuccuuuguguuca

SEQ ID NO: 542827 - RNA, 32 nt, Human
uuguguuccuugccccuguccaacccuggaca

SEQ ID NO: 542828 - RNA, 32 nt, Human
uuguguucucuuaaaauagaguuugaacaaau

SEQ ID NO: 542829 - RNA, 32 nt, Human
uuguguucuucccucuggcaauggcucccuuc

SEQ ID NO: 542830 - RNA, 24 nt, Human
uuguguucuuucuacuuuugggcu

SEQ ID NO: 542831 - RNA, 32 nt, Human
uuguguugcugauuuuucaguugaaaauguuu

SEQ ID NO: 542832 - RNA, 32 nt, Human
uuguguugggagaagcggcuggaguucauucu

SEQ ID NO: 542833 - RNA, 19 nt, Human
uuguguuguagucuagaca

SEQ ID NO: 542834 - RNA, 32 nt, Human
uuguguuguauugcauuuauuucccaaggccu

SEQ ID NO: 542835 - RNA, 32 nt, Human
uuguguugugaacaugaguuuuaugguauuuu

SEQ ID NO: 542836 - RNA, 32 nt, Human
uuguguuguuucuuaugacaauucugauuaga

SEQ ID NO: 542837 - RNA, 32 nt, Human
uuguguuuaaccuaaugcucagccuugguacu

SEQ ID NO: 542838 - RNA, 32 nt, Human
uuguguuuaacugcuacuuggagcucagaagc

SEQ ID NO: 542839 - RNA, 32 nt, Human
uuguguuuaauugcugcaaaagccacuuauua

SEQ ID NO: 542840 - RNA, 32 nt, Human
uuguguuuagagaauuaugggaaaccugguaa

SEQ ID NO: 542841 - RNA, 32 nt, Human
uuguguuuauauguucagaaccagaguagacu

SEQ ID NO: 542842 - RNA, 32 nt, Human
uuguguuucuaauacaggaucuggaaguagug

SEQ ID NO: 542843 - RNA, 32 nt, Human
uuguguuugcuacacugaccucuugcggucuu

SEQ ID NO: 542844 - RNA, 32 nt, Human
uuguguuuguagacaaaaggcaaagguauuau

SEQ ID NO: 542845 - RNA, 29 nt, Human
uuguguuuuaauaaacaauuugcagugac

SEQ ID NO: 542846 - RNA, 32 nt, Human
uuguguuuuauuugccaaauguuaccaaucag

SEQ ID NO: 542847 - RNA, 19 nt, Human
uuguguuuucuggcaccuu

SEQ ID NO: 542848 - RNA, 32 nt, Human
uuguguuuuguuuauccaugcuauagaacaag

SEQ ID NO: 542849 - RNA, 32 nt, Human
uuguguuuuucugcuuuugaaaucuguaucug

SEQ ID NO: 542850 - RNA, 32 nt, Human
uuguguuuuugucucauuguguuauugucuga

SEQ ID NO: 542851 - RNA, 32 nt, Human
uuguuaaaacauuuaauauuauauaggauauu

SEQ ID NO: 542852 - RNA, 32 nt, Human
uuguuaaaaguguagauuccaggccuccuuac

SEQ ID NO: 542853 - RNA, 32 nt, Human
uuguuaaacuauuauuauugaucacauuuuga

SEQ ID NO: 542854 - RNA, 32 nt, Human
uuguuaaacucauauauugaguuuuuaaauuu

SEQ ID NO: 542855 - RNA, 32 nt, Human
uuguuaaagcuauucuguagggcagagggcac

SEQ ID NO: 542856 - RNA, 32 nt, Human
uuguuaaauggagagaaaggcauggaaaaaug

SEQ ID NO: 542857 - RNA, 32 nt, Human
uuguuaaauuaaugccaaaauauuuuaauuuu

SEQ ID NO: 542858 - RNA, 32 nt, Human
uuguuaacaacaaggauaucucuucuggagua

SEQ ID NO: 542859 - RNA, 32 nt, Human
uuguuaaccauccucauauaccagggauaaau

SEQ ID NO: 542860 - RNA, 32 nt, Human
uuguuaacccagcgacgaacuuuccgaaaaau

SEQ ID NO: 542861 - RNA, 22 nt, Human
uuguuaacuaaaaacaguuugg

SEQ ID NO: 542862 - RNA, 32 nt, Human
uuguuaacuaaauuuaagguuuuguugaaccu

SEQ ID NO: 542863 - RNA, 32 nt, Human
uuguuaagaugacaaauggagagauggcaaga

SEQ ID NO: 542864 - RNA, 32 nt, Human
uuguuaagauggcuugaaaaguuucauuuuau

SEQ ID NO: 542865 - RNA, 30 nt, Human
uuguuaagccucucuguucagccuguuuua

SEQ ID NO: 542866 - RNA, 32 nt, Human
uuguuaagccuucugagggcagucuucuuuga

SEQ ID NO: 542867 - RNA, 32 nt, Human
uuguuaauaagugccaacuccuugugaaggcu

SEQ ID NO: 542868 - RNA, 32 nt, Human
uuguuaauagccacuauucuguugucuggaau

SEQ ID NO: 542869 - RNA, 32 nt, Human
uuguuaaucuaaaaucagcuugacuuaaucag

SEQ ID NO: 542870 - RNA, 32 nt, Human
uuguuaaucuguagcuuugccccagccacuuu

SEQ ID NO: 542871 - RNA, 32 nt, Human
uuguuaauucaaauaagcugauuuuaaugacg

SEQ ID NO: 542872 - RNA, 32 nt, Human
uuguuaauugcccucagccagcacuuuaggac

SEQ ID NO: 542873 - RNA, 32 nt, Human
uuguuaauuuguagcuuugccccagccacuuu

SEQ ID NO: 542874 - RNA, 32 nt, Human
uuguuaauuuugcucuauguuugccucugaag

SEQ ID NO: 542875 - RNA, 32 nt, Human
uuguuacaaucaaugaaccuacucugaaacau

SEQ ID NO: 542876 - RNA, 32 nt, Human
uuguuacagggccauuuacaccuauucacaaa

SEQ ID NO: 542877 - RNA, 31 nt, Human
uuguuacaguuucagguuauuuauauucgau

SEQ ID NO: 542878 - RNA, 32 nt, Human
uuguuacauauguauacaugugccauguuggu

SEQ ID NO: 542879 - RNA, 32 nt, Human
uuguuacauauguauacaugugccauguuugu

SEQ ID NO: 542880 - RNA, 32 nt, Human
uuguuacauuauagcuacauauuugugguuaa

SEQ ID NO: 542881 - RNA, 32 nt, Human
uuguuaccaaaaacaaaaccuggcagaugguc

SEQ ID NO: 542882 - RNA, 32 nt, Human
uuguuaccagccugggcaacauagugagaccc

SEQ ID NO: 542883 - RNA, 32 nt, Human
uuguuacccaggcaggagugcaguggcgugau

SEQ ID NO: 542884 - RNA, 24 nt, Human
uuguuacccaggcuggaguacagu

SEQ ID NO: 542885 - RNA, 32 nt, Human
uuguuacccaggcuggaguacaguggugucau

SEQ ID NO: 542886 - RNA, 32 nt, Human
uuguuacccaggcuggagugcaauggcacgca

SEQ ID NO: 542887 - RNA, 23 nt, Human
uuguuacccaggcuggagugcag

SEQ ID NO: 542888 - RNA, 24 nt, Human
uuguuacccaggcuggagugcagu

SEQ ID NO: 542889 - RNA, 32 nt, Human
uuguuacccaggcuggagugcaguggcacaau

SEQ ID NO: 542890 - RNA, 32 nt, Human
uuguuacccaggcuggagugcaguggcgcgau

SEQ ID NO: 542891 - RNA, 32 nt, Human
uuguuacccaggcuggagugcaguggcgugau

SEQ ID NO: 542892 - RNA, 32 nt, Human
uuguuacccccaccuaugccaggcugguacag

SEQ ID NO: 542893 - RNA, 32 nt, Human
uuguuaccccuugacagagcugcacccugaga

SEQ ID NO: 542894 - RNA, 19 nt, Human
uuguuaccgccguuuuuca

SEQ ID NO: 542895 - RNA, 32 nt, Human
uuguuacgagcaguuuuuccuggucaugguug

SEQ ID NO: 542896 - RNA, 32 nt, Human
uuguuacucauuuuauucacuaagcucgauaa

SEQ ID NO: 542897 - RNA, 32 nt, Human
uuguuacucauuuugaauauaccuuuuccuua

SEQ ID NO: 542898 - RNA, 32 nt, Human
uuguuacucucuggaagggaagguggaaaggg

SEQ ID NO: 542899 - RNA, 23 nt, Human
uuguuacugauucuccugucaga

SEQ ID NO: 542900 - RNA, 32 nt, Human
uuguuacuguccacccucauuucugccagcgc

SEQ ID NO: 542901 - RNA, 32 nt, Human
uuguuacuuagguauggagaggugggguuuuc

SEQ ID NO: 542902 - RNA, 31 nt, Human
uuguuacuucaauucuaucuguugaacuagg

SEQ ID NO: 542903 - RNA, 32 nt, Human
uuguuacuugcagcugaagauggaaagagcca

SEQ ID NO: 542904 - RNA, 23 nt, Human
uuguuacuuuaaacagaggcuga

SEQ ID NO: 542905 - RNA, 32 nt, Human
uuguuagacaauuuggccacuaacaucuccca

SEQ ID NO: 542906 - RNA, 32 nt, Human
uuguuagagacaccucagucgggccacaacug

SEQ ID NO: 542907 - RNA, 22 nt, Human
uuguuagagagcucugguuguu

SEQ ID NO: 542908 - RNA, 31 nt, Human
uuguuagaggaaggaacucuggcauucagag

SEQ ID NO: 542909 - RNA, 32 nt, Human
uuguuagcaaaaccaucucuugaguggagcuc

SEQ ID NO: 542910 - RNA, 32 nt, Human
uuguuagcagguuuguuuuuccugcuguugau

SEQ ID NO: 542911 - RNA, 24 nt, Human
uuguuagccgacuucugguagcuu

SEQ ID NO: 542912 - RNA, 32 nt, Human
uuguuagcgucccucugcauccaggcugaugg

SEQ ID NO: 542913 - RNA, 32 nt, Human
uuguuagcuacugccuguaggcauuuucagug

SEQ ID NO: 542914 - RNA, 32 nt, Human
uuguuagcuauaauuugaagaugaggaaacug

SEQ ID NO: 542915 - RNA, 32 nt, Human
uuguuagcuguucucagaaauguucuuucccu

SEQ ID NO: 542916 - RNA, 32 nt, Human
uuguuagcuuuuccuucuuucucuccagaaga

SEQ ID NO: 542917 - RNA, 32 nt, Human
uuguuaggaaugcagagucuaggccucacccu

SEQ ID NO: 542918 - RNA, 24 nt, Human
uuguuaggauguccugugcugcuu

SEQ ID NO: 542919 - RNA, 32 nt, Human
uuguuagggaggcaugauuuuggugagaucuu

SEQ ID NO: 542920 - RNA, 32 nt, Human
uuguuagucacaaauacuuagaacuggaaggc

SEQ ID NO: 542921 - RNA, 32 nt, Human
uuguuagucuacgccccacuguuuccacccau

SEQ ID NO: 542922 - RNA, 32 nt, Human
uuguuaguuaccacucaagagcagacagauau

SEQ ID NO: 542923 - RNA, 31 nt, Human
uuguuaguucacuucuuuuccacguucuucu

SEQ ID NO: 542924 - RNA, 21 nt, Human
uuguuaguugggaaagauuga

SEQ ID NO: 542925 - RNA, 32 nt, Human
uuguuauaugugcuuggcugggccaugggucc

SEQ ID NO: 542926 - RNA, 32 nt, Human
uuguuauauguguuuugcccugugccauucau

SEQ ID NO: 542927 - RNA, 32 nt, Human
uuguuauccaggcuggggugcaauggugcgau

SEQ ID NO: 542928 - RNA, 32 nt, Human
uuguuaucccacugcacucugcuuaaggguuc

SEQ ID NO: 542929 - RNA, 32 nt, Human
uuguuaucuagcugaaaacaaaugacaacuuu

SEQ ID NO: 542930 - RNA, 32 nt, Human
uuguuaucuuccaggugucuaaaucuccaguc

SEQ ID NO: 542931 - RNA, 32 nt, Human
uuguuauggggcuguuccaaaggagacacauc

SEQ ID NO: 542932 - RNA, 32 nt, Human
uuguuauguagugugcuuuuugucccuuuccu

SEQ ID NO: 542933 - RNA, 32 nt, Human
uuguuauguuuucgugcuuucucaucaaacca

SEQ ID NO: 542934 - RNA, 32 nt, Human
uuguuauuagguuuugguaacagcuguuguac

SEQ ID NO: 542935 - RNA, 32 nt, Human
uuguuauucauccuguguccucccucuucccg

SEQ ID NO: 542936 - RNA, 32 nt, Human
uuguuauugucucuuuuuaauuuuagccaucg

SEQ ID NO: 542937 - RNA, 32 nt, Human
uuguuauuuguuguuuuuaacaacuaaucaag

SEQ ID NO: 542938 - RNA, 32 nt, Human
uuguuauuuugaaagaguuucuuuuacugaga

SEQ ID NO: 542939 - RNA, 32 nt, Human
uuguucaaaaccuucaaaggcuucccaacuua

SEQ ID NO: 542940 - RNA, 32 nt, Human
uuguucaacacgccaagaaccuggacacucuu

SEQ ID NO: 542941 - RNA, 32 nt, Human
uuguucaauucaggugaggccugugaugacau

SEQ ID NO: 542942 - RNA, 32 nt, Human
uuguucacaaaaggauagagugugugcaucau

SEQ ID NO: 542943 - RNA, 32 nt, Human
uuguucacaaauucaagaagcuuaaaggucgu

SEQ ID NO: 542944 - RNA, 32 nt, Human
uuguucacacuuugcccuaugacauuucuaca

SEQ ID NO: 542945 - RNA, 25 nt, Human
uuguucacauacccaguaaugaaau

SEQ ID NO: 542946 - RNA, 32 nt, Human
uuguucacugcaaccucugccuuccaagauca

SEQ ID NO: 542947 - RNA, 32 nt, Human
uuguucagaaugucacgagccuuaugauauca

SEQ ID NO: 542948 - RNA, 32 nt, Human
uuguucagacugagcuuccugccugccuguac

SEQ ID NO: 542949 - RNA, 21 nt, Human
uuguucagacuggagugcagu

SEQ ID NO: 542950 - RNA, 22 nt, Human
uuguucagacuggagugcagug

SEQ ID NO: 542951 - RNA, 23 nt, Human
uuguucagacuggagugcagugg

SEQ ID NO: 542952 - RNA, 32 nt, Human
uuguucagaggcagagggugcaaaggagaaau

SEQ ID NO: 542953 - RNA, 32 nt, Human
uuguucagccacacuuugaggauucucuucag

SEQ ID NO: 542954 - RNA, 32 nt, Human
uuguucagcugcaugaauugagugaauaagaa

SEQ ID NO: 542955 - RNA, 32 nt, Human
uuguucagcugccucuuccagagcacacugau

SEQ ID NO: 542956 - RNA, 19 nt, Human
uuguucagcuguuuccaca

SEQ ID NO: 542957 - RNA, 32 nt, Human
uuguucaggccagccaacauacgacaguuuac

SEQ ID NO: 542958 - RNA, 32 nt, Human
uuguucagggagaagggggugcaggaggcaga

SEQ ID NO: 542959 - RNA, 21 nt, Human
uuguucagggguagcuuuuca

SEQ ID NO: 542960 - RNA, 32 nt, Human
uuguucagguauaaaugagcaguuaagauaua

SEQ ID NO: 542961 - RNA, 20 nt, Human
uuguucagguugcccuucac

SEQ ID NO: 542962 - RNA, 20 nt, Human
uuguucaguauaagcucguu

SEQ ID NO: 542963 - RNA, 32 nt, Human
uuguucagucagauuccucagcuauaaaaugc

SEQ ID NO: 542964 - RNA, 32 nt, Human
uuguucagugccugcggcuuuuccaggugcac

SEQ ID NO: 542965 - RNA, 21 nt, Human
uuguucagugucaccuuguca

SEQ ID NO: 542966 - RNA, 32 nt, Human
uuguucaucauuggcccucauuccaagcacuu

SEQ ID NO: 542967 - RNA, 32 nt, Human
uuguucaucccagccuccccauggcccucgcc

SEQ ID NO: 542968 - RNA, 31 nt, Human
uuguucaugauguaugugaugauggcuuacc

SEQ ID NO: 542969 - RNA, 32 nt, Human
uuguucauucucguaaccuccauauuuucagg

SEQ ID NO: 542970 - RNA, 32 nt, Human
uuguucauuuagaacugaguauucuggagaaa

SEQ ID NO: 542971 - RNA, 32 nt, Human
uuguucauuuccccucccuuagcuaccuucuu

SEQ ID NO: 542972 - RNA, 32 nt, Human
uuguucauuuguagcuuugccccagccacuuu

SEQ ID NO: 542973 - RNA, 32 nt, Human
uuguucauuugugccucagccauucuaguuuu

SEQ ID NO: 542974 - RNA, 32 nt, Human
uuguucauuuuaccucuuucuuacucuuacua

SEQ ID NO: 542975 - RNA, 32 nt, Human
uuguucauuuucagcacuuacuucaaaagaau

SEQ ID NO: 542976 - RNA, 21 nt, Human
uuguuccaacuucuccuugua

SEQ ID NO: 542977 - RNA, 32 nt, Human
uuguuccacgcaaaccagagugugucaguguu

SEQ ID NO: 542978 - RNA, 32 nt, Human
uuguuccacuccuccagcucugccuuagaaac

SEQ ID NO: 542979 - RNA, 32 nt, Human
uuguuccacugcaaauaaagccuuuuaaauca

SEQ ID NO: 542980 - RNA, 21 nt, Human
uuguuccagccaccuuuugca

SEQ ID NO: 542981 - RNA, 32 nt, Human
uuguuccagccucuucagacugugcaucuuuu

SEQ ID NO: 542982 - RNA, 32 nt, Human
uuguuccauggacauuaaaugagaccuuuucu

SEQ ID NO: 542983 - RNA, 32 nt, Human
uuguucccaaacaggauuaacugugaagacua

SEQ ID NO: 542984 - RNA, 32 nt, Human
uuguucccaagaaguguuuggaaugugcugua

SEQ ID NO: 542985 - RNA, 32 nt, Human
uuguucccagcaccugcugccucccagccuug

SEQ ID NO: 542986 - RNA, 24 nt, Human
uuguuccccaggcuggagugcaau

SEQ ID NO: 542987 - RNA, 32 nt, Human
uuguuccccaggcuggagugcaauggcacgau

SEQ ID NO: 542988 - RNA, 19 nt, Human
uuguucccccagccugcca

SEQ ID NO: 542989 - RNA, 32 nt, Human
uuguucccccuucacccuucucuguuaaccuu

SEQ ID NO: 542990 - RNA, 32 nt, Human
uuguucccccuucuacuuuuugcuucccugug

SEQ ID NO: 542991 - RNA, 32 nt, Human
uuguuccccucaggauccauagaguggacagu

SEQ ID NO: 542992 - RNA, 32 nt, Human
uuguucccucaccuauucauggcucucuuccu

SEQ ID NO: 542993 - RNA, 32 nt, Human
uuguucccucccucccugugcaugcaaacaag

SEQ ID NO: 542994 - RNA, 20 nt, Human
uuguucccugccauuuuuca

SEQ ID NO: 542995 - RNA, 32 nt, Human
uuguucccuggagaggcggagcugaauggccc

SEQ ID NO: 542996 - RNA, 32 nt, Human
uuguucccuggugucaaacuuugaaucuuugg

SEQ ID NO: 542997 - RNA, 32 nt, Human
uuguucccuguauccuaugggucuguuucuuu

SEQ ID NO: 542998 - RNA, 32 nt, Human
uuguuccuauuucuugcaccuucccauauuua

SEQ ID NO: 542999 - RNA, 25 nt, Human
uuguuccucaggaauagauuuuuca

SEQ ID NO: 543000 - RNA, 32 nt, Human
uuguuccuccuccuagcucucucccucagcca

SEQ ID NO: 543001 - RNA, 21 nt, Human
uuguuccucuguggcugaggu

SEQ ID NO: 543002 - RNA, 18 nt, Human
uuguuccugaugauuuca

SEQ ID NO: 543003 - RNA, 32 nt, Human
uuguuccugcauuaggggaaaguuggggacau

SEQ ID NO: 543004 - RNA, 32 nt, Human
uuguuccugcuguccccuccccuucaggcccc

SEQ ID NO: 543005 - RNA, 32 nt, Human
uuguuccugggaucgggcugaggccaggccuc

SEQ ID NO: 543006 - RNA, 32 nt, Human
uuguuccugugcaaauaaugaaagagcucggu

SEQ ID NO: 543007 - RNA, 32 nt, Human
uuguuccugugccguguggaccccagagcccc

SEQ ID NO: 543008 - RNA, 32 nt, Human
uuguuccuuacaucuuccaguuggaggugagu

SEQ ID NO: 543009 - RNA, 32 nt, Human
uuguuccuuauuagcuuuauuuuacuuuaugu

SEQ ID NO: 543010 - RNA, 32 nt, Human
uuguuccuucauuuucucugauuguuuuguuu

SEQ ID NO: 543011 - RNA, 32 nt, Human
uuguuccuucauuuucucuguuuuguuuuaga

SEQ ID NO: 543012 - RNA, 32 nt, Human
uuguuccuucuccauucccacugcuucacuug

SEQ ID NO: 543013 - RNA, 32 nt, Human
uuguuccuuuccccauccuuccuuccuucuug

SEQ ID NO: 543014 - RNA, 32 nt, Human
uuguucgacuguuucaaaacaugcuaauucca

SEQ ID NO: 543015 - RNA, 32 nt, Human
uuguucgcaccacugcaccacaacucaauaug

SEQ ID NO: 543016 - RNA, 19 nt, Human
uuguucgccgccgccgccg

SEQ ID NO: 543017 - RNA, 32 nt, Human
uuguucguccucccccacucccuccuaucguu

SEQ ID NO: 543018 - RNA, 32 nt, Human
uuguucguuuggauggaguuucguuuugucgc

SEQ ID NO: 543019 - RNA, 32 nt, Human
uuguucuaucuuguacagaaaacaguaaugga

SEQ ID NO: 543020 - RNA, 32 nt, Human
uuguucuaugcuaaaugcaucguuaggggagu

SEQ ID NO: 543021 - RNA, 32 nt, Human
uuguucucaccucuaccugucauuccagcauc

SEQ ID NO: 543022 - RNA, 32 nt, Human
uuguucucagcagucugauggaaggucucaaa

SEQ ID NO: 543023 - RNA, 32 nt, Human
uuguucucagcuucacagaggaagugaagcac

SEQ ID NO: 543024 - RNA, 32 nt, Human
uuguucuccaaagacccaaaaggcagauucac

SEQ ID NO: 543025 - RNA, 27 nt, Human
uuguucuccacucucaguaaaugaaau

SEQ ID NO: 543026 - RNA, 32 nt, Human
uuguucuccaucucaaaucuugaggagaagaa

SEQ ID NO: 543027 - RNA, 32 nt, Human
uuguucucccaaagugcugagauuacaggugu

SEQ ID NO: 543028 - RNA, 32 nt, Human
uuguucuccugguggagagagcuggaaggaag

SEQ ID NO: 543029 - RNA, 32 nt, Human
uuguucucugccccuuccuuccuuccuuccuu

SEQ ID NO: 543030 - RNA, 32 nt, Human
uuguucucuguuucgguuuuagcaggagagau

SEQ ID NO: 543031 - RNA, 32 nt, Human
uuguucucuuucuuauuguuuuucuaauuugu

SEQ ID NO: 543032 - RNA, 32 nt, Human
uuguucugagaacugacuuucuccccaucccc

SEQ ID NO: 543033 - RNA, 32 nt, Human
uuguucugagacauagcagugccuggcccagc

SEQ ID NO: 543034 - RNA, 32 nt, Human
uuguucugcgcagguuggagguagguggugag

SEQ ID NO: 543035 - RNA, 32 nt, Human
uuguucugcuucugcuuuaccucucaggacca

SEQ ID NO: 543036 - RNA, 32 nt, Human
uuguucuggaaaccaggauguucuauucuugg

SEQ ID NO: 543037 - RNA, 32 nt, Human
uuguucuggaaaccccagagagggcugggcuu

SEQ ID NO: 543038 - RNA, 32 nt, Human
uuguucugggagaagcuagggcgggucagagu

SEQ ID NO: 543039 - RNA, 32 nt, Human
uuguucugguuguagacugccaccuccucauu

SEQ ID NO: 543040 - RNA, 32 nt, Human
uuguucuguaccaugugggucucuccacagcg

SEQ ID NO: 543041 - RNA, 32 nt, Human
uuguucuguauauuuuaaugaucuuucacaag

SEQ ID NO: 543042 - RNA, 32 nt, Human
uuguucugucauggccagugggcaguuuguga

SEQ ID NO: 543043 - RNA, 32 nt, Human
uuguucugugcacuuguccaccccuguuaccc

SEQ ID NO: 543044 - RNA, 24 nt, Human
uuguucugugccuuuugccuggua

SEQ ID NO: 543045 - RNA, 32 nt, Human
uuguucugugugacccagcaaguggaaggaca

SEQ ID NO: 543046 - RNA, 32 nt, Human
uuguucuguugccugggcuggagugcaguggc

SEQ ID NO: 543047 - RNA, 23 nt, Human
uuguucuuaauaguagaaugaaa

SEQ ID NO: 543048 - RNA, 32 nt, Human
uuguucuuacucacucuucucauaaaauagga

SEQ ID NO: 543049 - RNA, 23 nt, Human
uuguucuuagucuuuuucuugua

SEQ ID NO: 543050 - RNA, 32 nt, Human
uuguucuucaaaguggaggucuccccugaucc

SEQ ID NO: 543051 - RNA, 32 nt, Human
uuguucuucccaaugucauauccaccaggacc

SEQ ID NO: 543052 - RNA, 19 nt, Human
uuguucuucccauuuuaca

SEQ ID NO: 543053 - RNA, 32 nt, Human
uuguucuuccuuccuuucuucccuccuccccc

SEQ ID NO: 543054 - RNA, 24 nt, Human
uuguucuuccuuuuuaauguaagu

SEQ ID NO: 543055 - RNA, 32 nt, Human
uuguucuucuucugcaguaucuggaaaaucug

SEQ ID NO: 543056 - RNA, 32 nt, Human
uuguucuugagugugucaaaauacagcuaguu

SEQ ID NO: 543057 - RNA, 32 nt, Human
uuguucuugggugcccuggagugaccccuacc

SEQ ID NO: 543058 - RNA, 32 nt, Human
uuguucuugguuuuguuucucgaucuuuuguu

SEQ ID NO: 543059 - RNA, 32 nt, Human
uuguucuuguugcccaggcugcagugcaaugg

SEQ ID NO: 543060 - RNA, 32 nt, Human
uuguucuuguugcccaggcuggaaugcaaugg

SEQ ID NO: 543061 - RNA, 21 nt, Human
uuguucuuugacagauuucca

SEQ ID NO: 543062 - RNA, 32 nt, Human
uuguucuuuggguccccugaugccauaggaga

SEQ ID NO: 543063 - RNA, 24 nt, Human
uuguucuuuuaguagcaaugaaau

SEQ ID NO: 543064 - RNA, 32 nt, Human
uuguugaagaaaagguaccagcuuuggaacga

SEQ ID NO: 543065 - RNA, 32 nt, Human
uuguugaaugauuaagucucuaaguaucuuaa

SEQ ID NO: 543066 - RNA, 32 nt, Human
uuguugaaugccaguuuugaccacagaagaau

SEQ ID NO: 543067 - RNA, 32 nt, Human
uuguugacaacaaaagaucauccaucgccuua

SEQ ID NO: 543068 - RNA, 32 nt, Human
uuguugacugggucaaagugaaggaauuucaa

SEQ ID NO: 543069 - RNA, 32 nt, Human
uuguugagaauggcugaacacacggccuacaa

SEQ ID NO: 543070 - RNA, 32 nt, Human
uuguugagcugcauuguguuaaaccaaauugu

SEQ ID NO: 543071 - RNA, 32 nt, Human
uuguugaggauccaugaccuucucccaugcau

SEQ ID NO: 543072 - RNA, 32 nt, Human
uuguugaggauucuggguugcagguaggcacc

SEQ ID NO: 543073 - RNA, 32 nt, Human
uuguugaggcuggaacuguuucuuuaaaaucc

SEQ ID NO: 543074 - RNA, 31 nt, Human
uuguugagugagagaauagaaaaagcgcuuu

SEQ ID NO: 543075 - RNA, 32 nt, Human
uuguugagugcaaauggagaacagcugcucac

SEQ ID NO: 543076 - RNA, 32 nt, Human
uuguugauauccacucucuucuuuccacuucc

SEQ ID NO: 543077 - RNA, 24 nt, Human
uuguugaugacauuuggguuguuu

SEQ ID NO: 543078 - RNA, 32 nt, Human
uuguugaugagcuauugagagcugcaguaguu

SEQ ID NO: 543079 - RNA, 32 nt, Human
uuguugaugaggcuggagugcaguggcgcgau

SEQ ID NO: 543080 - RNA, 32 nt, Human
uuguugauggcuuuaacagucaacacucuucu

SEQ ID NO: 543081 - RNA, 22 nt, Human
uuguugauucgucgccgaguca

SEQ ID NO: 543082 - RNA, 32 nt, Human
uuguugauuuaucaucuauuauuugaauucaa

SEQ ID NO: 543083 - RNA, 32 nt, Human
uuguugcaaaggaggaggaaaagggaggacuu

SEQ ID NO: 543084 - RNA, 32 nt, Human
uuguugcacuaccgcuguaucuguacauaauu

SEQ ID NO: 543085 - RNA, 32 nt, Human
uuguugcacuggcuaauguauuucuuauacag

SEQ ID NO: 543086 - RNA, 32 nt, Human
uuguugcagugggaagagaaggcacgacucug

SEQ ID NO: 543087 - RNA, 32 nt, Human
uuguugcaguguucaguuuccuugggggccug

SEQ ID NO: 543088 - RNA, 32 nt, Human
uuguugcauaucuguugccacucugaguuugg

SEQ ID NO: 543089 - RNA, 32 nt, Human
uuguugcauauuuaucccccuacccaucccuc

SEQ ID NO: 543090 - RNA, 32 nt, Human
uuguugccagcaccuuuagugcucagucuuca

SEQ ID NO: 543091 - RNA, 23 nt, Human
uuguugccaggcuggagugcagu

SEQ ID NO: 543092 - RNA, 24 nt, Human
uuguugccaggcuggagugcagug

SEQ ID NO: 543093 - RNA, 24 nt, Human
uuguugcccaaccuggagugcagu

SEQ ID NO: 543094 - RNA, 32 nt, Human
uuguugcccaaccuggagugcaguggugcggu

SEQ ID NO: 543095 - RNA, 22 nt, Human
uuguugcccaagcuggagugca

SEQ ID NO: 543096 - RNA, 24 nt, Human
uuguugcccaagcuggagugcaau

SEQ ID NO: 543097 - RNA, 32 nt, Human
uuguugcccaagcuggagugcaauggcacgau

SEQ ID NO: 543098 - RNA, 32 nt, Human
uuguugcccaagcuggagugcaauggcgcgau

SEQ ID NO: 543099 - RNA, 32 nt, Human
uuguugcccaagcuggagugcaguggcgcgau

SEQ ID NO: 543100 - RNA, 32 nt, Human
uuguugcccaagcuggagugcaguggugcaau

SEQ ID NO: 543101 - RNA, 32 nt, Human
uuguugcccacgcuggagugcaauggugcaau

SEQ ID NO: 543102 - RNA, 22 nt, Human
uuguugcccagacuggagugca

SEQ ID NO: 543103 - RNA, 24 nt, Human
uuguugcccagacuggagugcaau

SEQ ID NO: 543104 - RNA, 32 nt, Human
uuguugcccagacuggagugcaauggcacacg

SEQ ID NO: 543105 - RNA, 24 nt, Human
uuguugcccagacuggagugcagu

SEQ ID NO: 543106 - RNA, 32 nt, Human
uuguugcccagacuggagugcaguggcauaau

SEQ ID NO: 543107 - RNA, 22 nt, Human
uuguugcccagccuggagugca

SEQ ID NO: 543108 - RNA, 32 nt, Human
uuguugcccagccuggagugcaauagcgugau

SEQ ID NO: 543109 - RNA, 32 nt, Human
uuguugcccagccuggccaacauggugaaacc

SEQ ID NO: 543110 - RNA, 32 nt, Human
uuguugcccaggaagagacggaggaugcaaau

SEQ ID NO: 543111 - RNA, 32 nt, Human
uuguugcccaggccagagugcaauggcgugau

SEQ ID NO: 543112 - RNA, 21 nt, Human
uuguugcccaggcggaguaca

SEQ ID NO: 543113 - RNA, 32 nt, Human
uuguugcccaggcggagugcaguggaacaacc

SEQ ID NO: 543114 - RNA, 32 nt, Human
uuguugcccaggcuagagggcaauggugcaau

SEQ ID NO: 543115 - RNA, 22 nt, Human
uuguugcccaggcuagagugca

SEQ ID NO: 543116 - RNA, 24 nt, Human
uuguugcccaggcuagagugcaau

SEQ ID NO: 543117 - RNA, 32 nt, Human
uuguugcccaggcuagagugcaauggcacaau

SEQ ID NO: 543118 - RNA, 32 nt, Human
uuguugcccaggcuagagugcaauggcaugau

SEQ ID NO: 543119 - RNA, 32 nt, Human
uuguugcccaggcuagagugcaauggcgccau

SEQ ID NO: 543120 - RNA, 22 nt, Human
uuguugcccaggcuagcaugca

SEQ ID NO: 543121 - RNA, 24 nt, Human
uuguugcccaggcuagcaugcaau

SEQ ID NO: 543122 - RNA, 32 nt, Human
uuguugcccaggcuagcaugcaauggugugac

SEQ ID NO: 543123 - RNA, 32 nt, Human
uuguugcccaggcugaagugaucucggcucac

SEQ ID NO: 543124 - RNA, 21 nt, Human
uuguugcccaggcugaagugc

SEQ ID NO: 543125 - RNA, 22 nt, Human
uuguugcccaggcugaagugca

SEQ ID NO: 543126 - RNA, 24 nt, Human
uuguugcccaggcugaagugcaau

SEQ ID NO: 543127 - RNA, 32 nt, Human
uuguugcccaggcugaagugcaauguugugau

SEQ ID NO: 543128 - RNA, 23 nt, Human
uuguugcccaggcugaagugcag

SEQ ID NO: 543129 - RNA, 24 nt, Human
uuguugcccaggcugaagugcagu

SEQ ID NO: 543130 - RNA, 32 nt, Human
uuguugcccaggcugaagugcaguguugugau

SEQ ID NO: 543131 - RNA, 32 nt, Human
uuguugcccaggcugcagugcaauggcacaau

SEQ ID NO: 543132 - RNA, 32 nt, Human
uuguugcccaggcuggaaauggcgcgaucucg

SEQ ID NO: 543133 - RNA, 22 nt, Human
uuguugcccaggcuggaaugca

SEQ ID NO: 543134 - RNA, 24 nt, Human
uuguugcccaggcuggaaugcaau

SEQ ID NO: 543135 - RNA, 32 nt, Human
uuguugcccaggcuggaaugcaauggcgcgau

SEQ ID NO: 543136 - RNA, 32 nt, Human
uuguugcccaggcuggaaugcaauggcgugau

SEQ ID NO: 543137 - RNA, 23 nt, Human
uuguugcccaggcuggaaugcag

SEQ ID NO: 543138 - RNA, 24 nt, Human
uuguugcccaggcuggaaugcagu

SEQ ID NO: 543139 - RNA, 32 nt, Human
uuguugcccaggcuggaaugcaguggcacgau

SEQ ID NO: 543140 - RNA, 24 nt, Human
uuguugcccaggcuggagcgcagu

SEQ ID NO: 543141 - RNA, 32 nt, Human
uuguugcccaggcuggagcgcaguggggugau

SEQ ID NO: 543142 - RNA, 24 nt, Human
uuguugcccaggcuggagggcaau

SEQ ID NO: 543143 - RNA, 32 nt, Human
uuguugcccaggcuggagggcaauggugcaau

SEQ ID NO: 543144 - RNA, 22 nt, Human
uuguugcccaggcuggaguaca

SEQ ID NO: 543145 - RNA, 24 nt, Human
uuguugcccaggcuggaguacaau

SEQ ID NO: 543146 - RNA, 32 nt, Human
uuguugcccaggcuggaguacaauggcaugau

SEQ ID NO: 543147 - RNA, 32 nt, Human
uuguugcccaggcuggaguacaauggcgcgau

SEQ ID NO: 543148 - RNA, 32 nt, Human
uuguugcccaggcuggaguacaauggcgugau

SEQ ID NO: 543149 - RNA, 32 nt, Human
uuguugcccaggcuggaguacaauggugcgau

SEQ ID NO: 543150 - RNA, 23 nt, Human
uuguugcccaggcuggaguacag

SEQ ID NO: 543151 - RNA, 24 nt, Human
uuguugcccaggcuggaguacagu

SEQ ID NO: 543152 - RNA, 32 nt, Human
uuguugcccaggcuggaguacagugguaugau

SEQ ID NO: 543153 - RNA, 20 nt, Human
uuguugcccaggcuggagug

SEQ ID NO: 543154 - RNA, 32 nt, Human
uuguugcccaggcuggagugaaauggugcgau

SEQ ID NO: 543155 - RNA, 32 nt, Human
uuguugcccaggcuggagugaaguggcgugac

SEQ ID NO: 543156 - RNA, 32 nt, Human
uuguugcccaggcuggagugaguggcacaguc

SEQ ID NO: 543157 - RNA, 22 nt, Human
uuguugcccaggcuggagugca

SEQ ID NO: 543158 - RNA, 23 nt, Human
uuguugcccaggcuggagugcaa

SEQ ID NO: 543159 - RNA, 32 nt, Human
uuguugcccaggcuggagugcaacggcacgau

SEQ ID NO: 543160 - RNA, 32 nt, Human
uuguugcccaggcuggagugcaacggcaugau

SEQ ID NO: 543161 - RNA, 32 nt, Human
uuguugcccaggcuggagugcaacggcgcgcu

SEQ ID NO: 543162 - RNA, 32 nt, Human
uuguugcccaggcuggagugcaacggugcagu

SEQ ID NO: 543163 - RNA, 24 nt, Human
uuguugcccaggcuggagugcaau

SEQ ID NO: 543164 - RNA, 32 nt, Human
uuguugcccaggcuggagugcaauagcacgau

SEQ ID NO: 543165 - RNA, 32 nt, Human
uuguugcccaggcuggagugcaauagcaugau

SEQ ID NO: 543166 - RNA, 32 nt, Human
uuguugcccaggcuggagugcaauagcgcaau

SEQ ID NO: 543167 - RNA, 32 nt, Human
uuguugcccaggcuggagugcaauagcgcgau

SEQ ID NO: 543168 - RNA, 32 nt, Human
uuguugcccaggcuggagugcaaugacacgau

SEQ ID NO: 543169 - RNA, 32 nt, Human
uuguugcccaggcuggagugcaaugaugcaau

SEQ ID NO: 543170 - RNA, 32 nt, Human
uuguugcccaggcuggagugcaaugcgcgauc

SEQ ID NO: 543171 - RNA, 32 nt, Human
uuguugcccaggcuggagugcaauggagcgau

SEQ ID NO: 543172 - RNA, 32 nt, Human
uuguugcccaggcuggagugcaauggcacaac

SEQ ID NO: 543173 - RNA, 32 nt, Human
uuguugcccaggcuggagugcaauggcacaau

SEQ ID NO: 543174 - RNA, 32 nt, Human
uuguugcccaggcuggagugcaauggcaccau

SEQ ID NO: 543175 - RNA, 32 nt, Human
uuguugcccaggcuggagugcaauggcacgau

SEQ ID NO: 543176 - RNA, 32 nt, Human
uuguugcccaggcuggagugcaauggcauaau

SEQ ID NO: 543177 - RNA, 32 nt, Human
uuguugcccaggcuggagugcaauggcaugau

SEQ ID NO: 543178 - RNA, 32 nt, Human
uuguugcccaggcuggagugcaauggcgcaau

SEQ ID NO: 543179 - RNA, 32 nt, Human
uuguugcccaggcuggagugcaauggcgcgaa

SEQ ID NO: 543180 - RNA, 32 nt, Human
uuguugcccaggcuggagugcaauggcgcgau

SEQ ID NO: 543181 - RNA, 32 nt, Human
uuguugcccaggcuggagugcaauggcguaau

SEQ ID NO: 543182 - RNA, 32 nt, Human
uuguugcccaggcuggagugcaauggcguauc

SEQ ID NO: 543183 - RNA, 32 nt, Human
uuguugcccaggcuggagugcaauggcgugau

SEQ ID NO: 543184 - RNA, 32 nt, Human
uuguugcccaggcuggagugcaaugguacaau

SEQ ID NO: 543185 - RNA, 32 nt, Human
uuguugcccaggcuggagugcaaugguaugau

SEQ ID NO: 543186 - RNA, 32 nt, Human
uuguugcccaggcuggagugcaauggugcaau

SEQ ID NO: 543187 - RNA, 32 nt, Human
uuguugcccaggcuggagugcaauggugcagu

SEQ ID NO: 543188 - RNA, 32 nt, Human
uuguugcccaggcuggagugcaauggugcgau

SEQ ID NO: 543189 - RNA, 23 nt, Human
uuguugcccaggcuggagugcag

SEQ ID NO: 543190 - RNA, 24 nt, Human
uuguugcccaggcuggagugcagu

SEQ ID NO: 543191 - RNA, 32 nt, Human
uuguugcccaggcuggagugcaguagcacgau

SEQ ID NO: 543192 - RNA, 32 nt, Human
uuguugcccaggcuggagugcaguagcacuau

SEQ ID NO: 543193 - RNA, 32 nt, Human
uuguugcccaggcuggagugcagugacacaau

SEQ ID NO: 543194 - RNA, 32 nt, Human
uuguugcccaggcuggagugcaguggcacgau

SEQ ID NO: 543195 - RNA, 32 nt, Human
uuguugcccaggcuggagugcaguggcgccau

SEQ ID NO: 543196 - RNA, 32 nt, Human
uuguugcccaggcuggagugcaguggcgugau

SEQ ID NO: 543197 - RNA, 32 nt, Human
uuguugcccaggcuggagugcaguggucugau

SEQ ID NO: 543198 - RNA, 32 nt, Human
uuguugcccaggcuggagugcaguggugcaau

SEQ ID NO: 543199 - RNA, 32 nt, Human
uuguugcccaggcuggagugcaguggugcgau

SEQ ID NO: 543200 - RNA, 32 nt, Human
uuguugcccaggcuggagugcaguggugugau

SEQ ID NO: 543201 - RNA, 32 nt, Human
uuguugcccaggcuggagugcauuggcgcgau

SEQ ID NO: 543202 - RNA, 32 nt, Human
uuguugcccaggcuggagugccuuggcgcgau

SEQ ID NO: 543203 - RNA, 24 nt, Human
uuguugcccaggcuggagugcggu

SEQ ID NO: 543204 - RNA, 32 nt, Human
uuguugcccaggcuggagugcgguggcgugau

SEQ ID NO: 543205 - RNA, 32 nt, Human
uuguugcccaggcuggagugcggugguacaau

SEQ ID NO: 543206 - RNA, 32 nt, Human
uuguugcccaggcuggagugcgguggugcaau

SEQ ID NO: 543207 - RNA, 32 nt, Human
uuguugcccaggcuggagugcguuggcguggu

SEQ ID NO: 543208 - RNA, 32 nt, Human
uuguugcccaggcuggaguggaguggcgugau

SEQ ID NO: 543209 - RNA, 32 nt, Human
uuguugcccaggcuggaguguaguggcgcgau

SEQ ID NO: 543210 - RNA, 32 nt, Human
uuguugcccaggcuggagugugaugggcucga

SEQ ID NO: 543211 - RNA, 32 nt, Human
uuguugcccaggcuggagugugguggggcaau

SEQ ID NO: 543212 - RNA, 32 nt, Human
uuguugcccaggcuggaguucaguggcgugau

SEQ ID NO: 543213 - RNA, 32 nt, Human
uuguugcccaggcugggagggcaauggcaccg

SEQ ID NO: 543214 - RNA, 32 nt, Human
uuguugcccaggcuggggugcaguggcacgau

SEQ ID NO: 543215 - RNA, 24 nt, Human
uuguugcccaggcuggugugcaau

SEQ ID NO: 543216 - RNA, 32 nt, Human
uuguugcccaggcuggugugcaauggcgugau

SEQ ID NO: 543217 - RNA, 22 nt, Human
uuguugcccaggcuguaguaca

SEQ ID NO: 543218 - RNA, 24 nt, Human
uuguugcccaggcuguaguacaau

SEQ ID NO: 543219 - RNA, 32 nt, Human
uuguugcccaggcuguaguacaauggcaugau

SEQ ID NO: 543220 - RNA, 23 nt, Human
uuguugcccaggcuugagugcag

SEQ ID NO: 543221 - RNA, 32 nt, Human
uuguugcccaggcuugagugcagugaugcaau

SEQ ID NO: 543222 - RNA, 32 nt, Human
uuguugcccagggcuggagugcaguggcauga

SEQ ID NO: 543223 - RNA, 23 nt, Human
uuguugcccagguuagagugcag

SEQ ID NO: 543224 - RNA, 24 nt, Human
uuguugcccagguuagagugcagu

SEQ ID NO: 543225 - RNA, 32 nt, Human
uuguugccccacacagccuccugcugcaggug

SEQ ID NO: 543226 - RNA, 32 nt, Human
uuguugcccgggcuggaaugcaauggcgcgau

SEQ ID NO: 543227 - RNA, 22 nt, Human
uuguugcccgggcuggagugca

SEQ ID NO: 543228 - RNA, 32 nt, Human
uuguugcccgggcuggagugcaauggcgcgaa

SEQ ID NO: 543229 - RNA, 32 nt, Human
uuguugcccgggcuggagugcaauggugagau

SEQ ID NO: 543230 - RNA, 32 nt, Human
uuguugccgaaacuguuuauggccuucuuguu

SEQ ID NO: 543231 - RNA, 32 nt, Human
uuguugccgaggcuggagugcaauggcgcaac

SEQ ID NO: 543232 - RNA, 22 nt, Human
uuguugccuaggcuggagugca

SEQ ID NO: 543233 - RNA, 24 nt, Human
uuguugccuaggcuggagugcaau

SEQ ID NO: 543234 - RNA, 32 nt, Human
uuguugccuaggcuggagugcaauggcgagau

SEQ ID NO: 543235 - RNA, 32 nt, Human
uuguugccuaggcuggagugcaauggugcgau

SEQ ID NO: 543236 - RNA, 24 nt, Human
uuguugccuaggcuggagugcagu

SEQ ID NO: 543237 - RNA, 32 nt, Human
uuguugccuaggcuggagugcaguggcgcagu

SEQ ID NO: 543238 - RNA, 32 nt, Human
uuguugccucuccugcuucuucauacagagug

SEQ ID NO: 543239 - RNA, 32 nt, Human
uuguugccuuucuuccaagccauggccaugcc

SEQ ID NO: 543240 - RNA, 32 nt, Human
uuguugcgcaggcuggagugcaauggugcaau

SEQ ID NO: 543241 - RNA, 32 nt, Human
uuguugcuaugagucaaggaguguaaccuucu

SEQ ID NO: 543242 - RNA, 32 nt, Human
uuguugcucaggcuggaguacaguggcauaau

SEQ ID NO: 543243 - RNA, 19 nt, Human
uuguugcucccaccgaguu

SEQ ID NO: 543244 - RNA, 17 nt, Human
uuguugcucgcccggcc

SEQ ID NO: 543245 - RNA, 18 nt, Human
uuguugcucguagagcca

SEQ ID NO: 543246 - RNA, 17 nt, Human
uuguugcucguccugcc

SEQ ID NO: 543247 - RNA, 32 nt, Human
uuguugcugaggcuggagugcaguggcaccau

SEQ ID NO: 543248 - RNA, 32 nt, Human
uuguugcugcugcugcucauuccacacuguug

SEQ ID NO: 543249 - RNA, 22 nt, Human
uuguugcugcuucucuagugga

SEQ ID NO: 543250 - RNA, 32 nt, Human
uuguugcuggccccagcgccuggugcaggaag

SEQ ID NO: 543251 - RNA, 19 nt, Human
uuguugcuggcccugggcu

SEQ ID NO: 543252 - RNA, 32 nt, Human
uuguugcuuaggaugaggagacucuguaauuu

SEQ ID NO: 543253 - RNA, 32 nt, Human
uuguugcuucauugcuaguuuguauuucuaac

SEQ ID NO: 543254 - RNA, 32 nt, Human
uuguugcuuuggaauagauggagcugccccag

SEQ ID NO: 543255 - RNA, 32 nt, Human
uuguuggaacacaaaugaugcuagagguugug

SEQ ID NO: 543256 - RNA, 24 nt, Human
uuguuggacuccagcuuugagcca

SEQ ID NO: 543257 - RNA, 32 nt, Human
uuguuggacuccuauucaugcuucaaagucca

SEQ ID NO: 543258 - RNA, 32 nt, Human
uuguuggagcaagaggagaaguugcuggagca

SEQ ID NO: 543259 - RNA, 32 nt, Human
uuguuggauugugcuguuugggagaggugaca

SEQ ID NO: 543260 - RNA, 32 nt, Human
uuguuggccggaucaccaucugaagagcagac

SEQ ID NO: 543261 - RNA, 20 nt, Human
uuguuggccgggugcagugg

SEQ ID NO: 543262 - RNA, 32 nt, Human
uuguuggcuaggcuggaguaaaauggugcgau

SEQ ID NO: 543263 - RNA, 32 nt, Human
uuguuggcucacagcaaggccuuuucacagag

SEQ ID NO: 543264 - RNA, 32 nt, Human
uuguuggcuuaucuucauaaauaauuugucug

SEQ ID NO: 543265 - RNA, 32 nt, Human
uuguugggaggaggaggaaagggaaggcuggc

SEQ ID NO: 543266 - RNA, 32 nt, Human
uuguugggaggccaaagcaggaggauagcuug

SEQ ID NO: 543267 - RNA, 32 nt, Human
uuguugggagucaagugacagagcagaccugg

SEQ ID NO: 543268 - RNA, 32 nt, Human
uuguugggaugggguuuugcgauguugcccag

SEQ ID NO: 543269 - RNA, 32 nt, Human
uuguugggcagcagaaaaccaccaaaguuaag

SEQ ID NO: 543270 - RNA, 32 nt, Human
uuguugggccuuucuguuguuucuuuguuuuc

SEQ ID NO: 543271 - RNA, 32 nt, Human
uuguuggggagagaggcagaggcagcuggagc

SEQ ID NO: 543272 - RNA, 32 nt, Human
uuguuggggccagaaauguccacguccugagc

SEQ ID NO: 543273 - RNA, 32 nt, Human
uuguuggguaacucagccauggagaugccaag

SEQ ID NO: 543274 - RNA, 24 nt, Human
uuguugggucucucuguguuguuu

SEQ ID NO: 543275 - RNA, 32 nt, Human
uuguuggguuaaauguucauggucaacuccaa

SEQ ID NO: 543276 - RNA, 32 nt, Human
uuguuggguuuugagcaggcuguuauagugag

SEQ ID NO: 543277 - RNA, 32 nt, Human
uuguuggugaaauaugucgaggaccagaugcu

SEQ ID NO: 543278 - RNA, 32 nt, Human
uuguuggugaggaaauuaauuaugacuugaua

SEQ ID NO: 543279 - RNA, 23 nt, Human
uuguuggugcucuuccggcugcu

SEQ ID NO: 543280 - RNA, 32 nt, Human
uuguuggugggaguggucuccggaggccuccc

SEQ ID NO: 543281 - RNA, 32 nt, Human
uuguugguucuuggaccccauuuugcaccuau

SEQ ID NO: 543282 - RNA, 32 nt, Human
uuguugguugugcuucugccucuggacgccgc

SEQ ID NO: 543283 - RNA, 32 nt, Human
uuguuguaaaacugaaucaugucagaacugcu

SEQ ID NO: 543284 - RNA, 32 nt, Human
uuguuguaaagacauuguuuuucagacuuuuc

SEQ ID NO: 543285 - RNA, 32 nt, Human
uuguuguauagaacaguuuuuaggcagccuuu

SEQ ID NO: 543286 - RNA, 32 nt, Human
uuguuguauuuuuaguagagacaggguuucac

SEQ ID NO: 543287 - RNA, 32 nt, Human
uuguugucauuuguaacaggucacuuccuuuu

SEQ ID NO: 543288 - RNA, 32 nt, Human
uuguuguccaggcuagagugcaauggcaugau

SEQ ID NO: 543289 - RNA, 22 nt, Human
uuguuguccaggcuggagugca

SEQ ID NO: 543290 - RNA, 24 nt, Human
uuguuguccaggcuggagugcaau

SEQ ID NO: 543291 - RNA, 32 nt, Human
uuguuguccaggcuggagugcaauggcacgau

SEQ ID NO: 543292 - RNA, 32 nt, Human
uuguuguccaggcuggagugcaauggcgcaau

SEQ ID NO: 543293 - RNA, 23 nt, Human
uuguuguccaggcuggagugcag

SEQ ID NO: 543294 - RNA, 24 nt, Human
uuguuguccaggcuggagugcagu

SEQ ID NO: 543295 - RNA, 32 nt, Human
uuguuguccaggcuggagugcaguggcgcgau

SEQ ID NO: 543296 - RNA, 22 nt, Human
uuguuguccagucuggagugca

SEQ ID NO: 543297 - RNA, 24 nt, Human
uuguuguccagucuggagugcaau

SEQ ID NO: 543298 - RNA, 32 nt, Human
uuguuguccagucuggagugcaauggcacaau

SEQ ID NO: 543299 - RNA, 32 nt, Human
uuguugucuaggcuggagugccguggugcgau

SEQ ID NO: 543300 - RNA, 32 nt, Human
uuguugucucuuccucuucagaacucuugucc

SEQ ID NO: 543301 - RNA, 32 nt, Human
uuguugugaaacacugcuuccugaaacuuccu

SEQ ID NO: 543302 - RNA, 32 nt, Human
uuguugugaagccagacagugaccucaaaugu

SEQ ID NO: 543303 - RNA, 32 nt, Human
uuguugugagccccuguccuucuuaguugucc

SEQ ID NO: 543304 - RNA, 32 nt, Human
uuguuguggagaauugggacaggcagagccag

SEQ ID NO: 543305 - RNA, 32 nt, Human
uuguuguggauuccagugaugaagagagaaug

SEQ ID NO: 543306 - RNA, 32 nt, Human
uuguuguggcucuuuuugucugugccaguugg

SEQ ID NO: 543307 - RNA, 32 nt, Human
uuguuguguaacaaaccaccccaaaacuuacu

SEQ ID NO: 543308 - RNA, 29 nt, Human
uuguugugucugugcuaaccugggaacug

SEQ ID NO: 543309 - RNA, 32 nt, Human
uuguuguguucuguugaaggugccauuuuaaa

SEQ ID NO: 543310 - RNA, 32 nt, Human
uuguuguucaagaacauaagcaaccaguagcu

SEQ ID NO: 543311 - RNA, 18 nt, Human
uuguuguucacugggcca

SEQ ID NO: 543312 - RNA, 32 nt, Human
uuguuguucucaggacuucugggcauggcagu

SEQ ID NO: 543313 - RNA, 32 nt, Human
uuguuguucucgggaaggcgguugcagcacuc

SEQ ID NO: 543314 - RNA, 32 nt, Human
uuguuguugcagaaacugugucagaggaauaa

SEQ ID NO: 543315 - RNA, 19 nt, Human
uuguuguugcccagagcca

SEQ ID NO: 543316 - RNA, 20 nt, Human
uuguuguuguuuuugggcca

SEQ ID NO: 543317 - RNA, 32 nt, Human
uuguuguuuaaauaccuaucacugugguagag

SEQ ID NO: 543318 - RNA, 32 nt, Human
uuguuguuucccucugaggcuugcaaagaagg

SEQ ID NO: 543319 - RNA, 32 nt, Human
uuguuguuuccuuuugagauggagucuugcuc

SEQ ID NO: 543320 - RNA, 32 nt, Human
uuguuguuugagauagagucuugcuaguguca

SEQ ID NO: 543321 - RNA, 32 nt, Human
uuguuguuugagauagagucuugcuaguguug

SEQ ID NO: 543322 - RNA, 18 nt, Human
uuguuguuugccaagcua

SEQ ID NO: 543323 - RNA, 32 nt, Human
uuguuguuuguugacagcuuggaaagggaaga

SEQ ID NO: 543324 - RNA, 32 nt, Human
uuguuguuuugagacagggucuugcccuguug

SEQ ID NO: 543325 - RNA, 32 nt, Human
uuguuguuuuucuguguuguuuucccuggaug

SEQ ID NO: 543326 - RNA, 32 nt, Human
uuguuuaaauggagacuuccaaucaccagcuc

SEQ ID NO: 543327 - RNA, 32 nt, Human
uuguuuaaccauuuaccuuauucucaguuuuu

SEQ ID NO: 543328 - RNA, 32 nt, Human
uuguuuaaggagguggggcgcguuucaguggc

SEQ ID NO: 543329 - RNA, 32 nt, Human
uuguuuaaucaucauggugguccuaccuggau

SEQ ID NO: 543330 - RNA, 32 nt, Human
uuguuuaaugucucucugaaugcaguuuuaaa

SEQ ID NO: 543331 - RNA, 32 nt, Human
uuguuuaauuccugauuuuaaagccugcucua

SEQ ID NO: 543332 - RNA, 32 nt, Human
uuguuuacacauuuccuguuguacauuuaggu

SEQ ID NO: 543333 - RNA, 32 nt, Human
uuguuuaccaaggaguauugucaguguuuugu

SEQ ID NO: 543334 - RNA, 32 nt, Human
uuguuuagaaguucggaccaacagaaaaaugc

SEQ ID NO: 543335 - RNA, 32 nt, Human
uuguuuagacuuuuauuuauacucuucugauu

SEQ ID NO: 543336 - RNA, 32 nt, Human
uuguuuagcaucuucuuuaccuccaguguucc

SEQ ID NO: 543337 - RNA, 32 nt, Human
uuguuuagcuggugagggaagagggugggcaa

SEQ ID NO: 543338 - RNA, 32 nt, Human
uuguuuagggccugggaauuggccauguguua

SEQ ID NO: 543339 - RNA, 32 nt, Human
uuguuuaguccugcaagacugaugcuuaauac

SEQ ID NO: 543340 - RNA, 32 nt, Human
uuguuuaguuauuguuucuauuucucauacau

SEQ ID NO: 543341 - RNA, 32 nt, Human
uuguuuaguuuuuacuugggugcaauguguac

SEQ ID NO: 543342 - RNA, 32 nt, Human
uuguuuauacaguuuguauaggcugacuucug

SEQ ID NO: 543343 - RNA, 32 nt, Human
uuguuuauauuagacaaugcucugugaauauu

SEQ ID NO: 543344 - RNA, 25 nt, Human
uuguuuaucaguucaaaaaugcucu

SEQ ID NO: 543345 - RNA, 32 nt, Human
uuguuuaucuuucuguucaucuauucugucua

SEQ ID NO: 543346 - RNA, 32 nt, Human
uuguuuauggccaguuuuggggccaguuuaug

SEQ ID NO: 543347 - RNA, 32 nt, Human
uuguuuaugguuguguaccuacuuugagaaga

SEQ ID NO: 543348 - RNA, 32 nt, Human
uuguuuauuugccaacacaaguuuacauauau

SEQ ID NO: 543349 - RNA, 32 nt, Human
uuguuucaaauaccuuucucaacauaaaagga

SEQ ID NO: 543350 - RNA, 32 nt, Human
uuguuucaaauguuaauuuacauaggauuuuu

SEQ ID NO: 543351 - RNA, 32 nt, Human
uuguuucacuuugacauuuggggaucuggugg

SEQ ID NO: 543352 - RNA, 32 nt, Human
uuguuucagcagcuuugguugcacugaauuug

SEQ ID NO: 543353 - RNA, 24 nt, Human
uuguuucaguagcccauguacuaa

SEQ ID NO: 543354 - RNA, 32 nt, Human
uuguuucagugucauuuuaaauguuuucuugu

SEQ ID NO: 543355 - RNA, 32 nt, Human
uuguuucauuucuggagacuguaugcaucacu

SEQ ID NO: 543356 - RNA, 32 nt, Human
uuguuuccagcuaauuauugugguguacuaua

SEQ ID NO: 543357 - RNA, 32 nt, Human
uuguuuccaggagcauagaagccacaucguug

SEQ ID NO: 543358 - RNA, 24 nt, Human
uuguuucccaggcuggagugcaau

SEQ ID NO: 543359 - RNA, 32 nt, Human
uuguuucccaggcuggagugcaauggcacaau

SEQ ID NO: 543360 - RNA, 32 nt, Human
uuguuucccaggcuggagugcaaugggugauc

SEQ ID NO: 543361 - RNA, 32 nt, Human
uuguuucccaggcuggagugcaguggcacgau

SEQ ID NO: 543362 - RNA, 32 nt, Human
uuguuucccaggcuggggugggggccugagca

SEQ ID NO: 543363 - RNA, 32 nt, Human
uuguuucccucccagccccaaaccuuuuguuc

SEQ ID NO: 543364 - RNA, 32 nt, Human
uuguuucccuucacuuucagucuuccacacac

SEQ ID NO: 543365 - RNA, 32 nt, Human
uuguuucccuuuccuuucuccaguccacgugu

SEQ ID NO: 543366 - RNA, 32 nt, Human
uuguuuccucaccacuuuucccuuaauucuaa

SEQ ID NO: 543367 - RNA, 32 nt, Human
uuguuuccugcccucacugcauucccucaccu

SEQ ID NO: 543368 - RNA, 32 nt, Human
uuguuuccugcucuccucugcccuuucugaaa

SEQ ID NO: 543369 - RNA, 32 nt, Human
uuguuuccugcucugaggcuugugggguggga

SEQ ID NO: 543370 - RNA, 32 nt, Human
uuguuuccuggugagcacagaaucagaacaaa

SEQ ID NO: 543371 - RNA, 22 nt, Human
uuguuucguaaagauaaccagu

SEQ ID NO: 543372 - RNA, 32 nt, Human
uuguuucuacagauggcaacagcuccauaggg

SEQ ID NO: 543373 - RNA, 32 nt, Human
uuguuucuacuacauggaagaccucauuuuga

SEQ ID NO: 543374 - RNA, 32 nt, Human
uuguuucuagaaguccagaauuuuggaccucc

SEQ ID NO: 543375 - RNA, 32 nt, Human
uuguuucucagccaucaaaugauaaugacuaa

SEQ ID NO: 543376 - RNA, 32 nt, Human
uuguuucuccaagccugcuuugugcuucucac

SEQ ID NO: 543377 - RNA, 24 nt, Human
uuguuucuccccaaaucuagaaau

SEQ ID NO: 543378 - RNA, 24 nt, Human
uuguuucuccccacaucuagaaau

SEQ ID NO: 543379 - RNA, 23 nt, Human
uuguuucucccugcucaugaggu

SEQ ID NO: 543380 - RNA, 32 nt, Human
uuguuucuccuggguuaggccccggcuucacu

SEQ ID NO: 543381 - RNA, 32 nt, Human
uuguuucugagacggagucucagucugucacc

SEQ ID NO: 543382 - RNA, 23 nt, Human
uuguuucugagccuaaugaggua

SEQ ID NO: 543383 - RNA, 32 nt, Human
uuguuucugcccugccagcugcagccugguug

SEQ ID NO: 543384 - RNA, 32 nt, Human
uuguuucugccuccugcuauuuuucuuuugac

SEQ ID NO: 543385 - RNA, 32 nt, Human
uuguuucugcugcugugaaaccccaaaguaau

SEQ ID NO: 543386 - RNA, 32 nt, Human
uuguuucuguuucuuuggcuuuucucgcuccg

SEQ ID NO: 543387 - RNA, 32 nt, Human
uuguuucuuacaccuucauucucuccagcauc

SEQ ID NO: 543388 - RNA, 23 nt, Human
uuguuucuucugaguggggaaau

SEQ ID NO: 543389 - RNA, 32 nt, Human
uuguuucuugcugccuaucuguaaguaauuaa

SEQ ID NO: 543390 - RNA, 32 nt, Human
uuguuucuuuguuucguuuccucugcugucuu

SEQ ID NO: 543391 - RNA, 32 nt, Human
uuguuugaaaguaagaaagggaggggaaacuu

SEQ ID NO: 543392 - RNA, 32 nt, Human
uuguuugaacccaggaggcacagguugcagug

SEQ ID NO: 543393 - RNA, 32 nt, Human
uuguuugaacccaggagguggacauuacagug

SEQ ID NO: 543394 - RNA, 32 nt, Human
uuguuugaacccaggagguggaggcugcagug

SEQ ID NO: 543395 - RNA, 32 nt, Human
uuguuugaaccuuagugccuuacccuguccuc

SEQ ID NO: 543396 - RNA, 32 nt, Human
uuguuugaagcacuucgucuuacccauuuaug

SEQ ID NO: 543397 - RNA, 32 nt, Human
uuguuugacauuuugcuuuuugugcacuguga

SEQ ID NO: 543398 - RNA, 32 nt, Human
uuguuugaccucaggacaaguucuaaucucua

SEQ ID NO: 543399 - RNA, 32 nt, Human
uuguuugagacagagucucccucugucaccca

SEQ ID NO: 543400 - RNA, 32 nt, Human
uuguuugagacagggucucacucugucaccca

SEQ ID NO: 543401 - RNA, 32 nt, Human
uuguuugagacagggucucacucugucgcuca

SEQ ID NO: 543402 - RNA, 32 nt, Human
uuguuugagacagggucucccucugucaucca

SEQ ID NO: 543403 - RNA, 32 nt, Human
uuguuugagacagggucuugcucugucaccca

SEQ ID NO: 543404 - RNA, 32 nt, Human
uuguuugagacagggucuuucucugucaccca

SEQ ID NO: 543405 - RNA, 32 nt, Human
uuguuugagauggagucucacucugucaccca

SEQ ID NO: 543406 - RNA, 32 nt, Human
uuguuugagauggagucucacucugucaccua

SEQ ID NO: 543407 - RNA, 32 nt, Human
uuguuugagauggagucuugcucugucaccca

SEQ ID NO: 543408 - RNA, 32 nt, Human
uuguuugagcccaggaauuugagaacaggauu

SEQ ID NO: 543409 - RNA, 32 nt, Human
uuguuugagcccaggagguugaggcugcagug

SEQ ID NO: 543410 - RNA, 32 nt, Human
uuguuugagcccuggagguugaggcugcagug

SEQ ID NO: 543411 - RNA, 32 nt, Human
uuguuugaugauuuuuaaucguuacuauuauu

SEQ ID NO: 543412 - RNA, 32 nt, Human
uuguuugauggauaaauuccaucucugggaau

SEQ ID NO: 543413 - RNA, 31 nt, Human
uuguuugaugugggagaaaaagcgacugggg

SEQ ID NO: 543414 - RNA, 32 nt, Human
uuguuugauuccucccaccuugcugaucauuc

SEQ ID NO: 543415 - RNA, 32 nt, Human
uuguuugauucuguaguuaaauuuccacauuu

SEQ ID NO: 543416 - RNA, 32 nt, Human
uuguuugcaaacauguuuuaaauuaaauucgg

SEQ ID NO: 543417 - RNA, 32 nt, Human
uuguuugcaagacgucugcauguccacaagug

SEQ ID NO: 543418 - RNA, 32 nt, Human
uuguuugcaggauccucagccauguucaagug

SEQ ID NO: 543419 - RNA, 32 nt, Human
uuguuugcagggccugggcaaaaauuuacacu

SEQ ID NO: 543420 - RNA, 32 nt, Human
uuguuugcauuuaugaaucuugcugccuuuua

SEQ ID NO: 543421 - RNA, 32 nt, Human
uuguuugccucuuuggaaacuguuauccuucc

SEQ ID NO: 543422 - RNA, 32 nt, Human
uuguuugccuucccaccugccucugccacacc

SEQ ID NO: 543423 - RNA, 32 nt, Human
uuguuugccuuuugucaacuugcccugcuuug

SEQ ID NO: 543424 - RNA, 32 nt, Human
uuguuugcugggaggcgggagaugcagccagg

SEQ ID NO: 543425 - RNA, 32 nt, Human
uuguuugcugggaggugggagaugcagccagg

SEQ ID NO: 543426 - RNA, 32 nt, Human
uuguuugcuguugucacagucagcugguuucg

SEQ ID NO: 543427 - RNA, 32 nt, Human
uuguuugcuucaugugucccagaagaugacug

SEQ ID NO: 543428 - RNA, 17 nt, Human
uuguuugcuuccuacaa

SEQ ID NO: 543429 - RNA, 32 nt, Human
uuguuugcuugcuuucuuuuguucuguuuuag

SEQ ID NO: 543430 - RNA, 32 nt, Human
uuguuuggaagacuucuaaagaaacugcucca

SEQ ID NO: 543431 - RNA, 32 nt, Human
uuguuuggagaacaacaaggacaacuuuaugu

SEQ ID NO: 543432 - RNA, 32 nt, Human
uuguuuggcagugguugcuguccucuuggcau

SEQ ID NO: 543433 - RNA, 32 nt, Human
uuguuuggccugugauuguaugacuuuugcgg

SEQ ID NO: 543434 - RNA, 32 nt, Human
uuguuugggaggcauagugcugacauauauuc

SEQ ID NO: 543435 - RNA, 32 nt, Human
uuguuuggguacuguauaugagaucaggaaaa

SEQ ID NO: 543436 - RNA, 32 nt, Human
uuguuugguauagaaguguuggaacguacacc

SEQ ID NO: 543437 - RNA, 32 nt, Human
uuguuuguaaaaccaucagauauuucuuaugg

SEQ ID NO: 543438 - RNA, 32 nt, Human
uuguuuguaugaagaugcuguacccacuugaa

SEQ ID NO: 543439 - RNA, 32 nt, Human
uuguuugucauugagucuucucucagaaucag

SEQ ID NO: 543440 - RNA, 32 nt, Human
uuguuugucccuggacuggccaugaagugagg

SEQ ID NO: 543441 - RNA, 29 nt, Human
uuguuuguccugucuuugccuggauccau

SEQ ID NO: 543442 - RNA, 32 nt, Human
uuguuugucuucccaucccccuaaaacauaaa

SEQ ID NO: 543443 - RNA, 32 nt, Human
uuguuugucuuccccacauagaaaguuagcua

SEQ ID NO: 543444 - RNA, 29 nt, Human
uuguuuguguuguguguggaaauggcgaa

SEQ ID NO: 543445 - RNA, 32 nt, Human
uuguuuguuaacguacugugacuuuaacuuua

SEQ ID NO: 543446 - RNA, 32 nt, Human
uuguuuguugagauaaggucuugcuguguggc

SEQ ID NO: 543447 - RNA, 32 nt, Human
uuguuuguugcucuuuccuucucuccaucaua

SEQ ID NO: 543448 - RNA, 32 nt, Human
uuguuuguuucuucaugccuuuacuuacuuug

SEQ ID NO: 543449 - RNA, 32 nt, Human
uuguuuguuucuugaaaaugagagaagagccg

SEQ ID NO: 543450 - RNA, 32 nt, Human
uuguuuguuugcagucucucucugccauggcc

SEQ ID NO: 543451 - RNA, 32 nt, Human
uuguuuguuuucuuugagauggagucucgcuc

SEQ ID NO: 543452 - RNA, 32 nt, Human
uuguuuguuuuuaagaaaagcucaguucuaga

SEQ ID NO: 543453 - RNA, 20 nt, Human
uuguuuuaaaaacuggcccu

SEQ ID NO: 543454 - RNA, 32 nt, Human
uuguuuuaaaacugaucaguuuugccaagggg

SEQ ID NO: 543455 - RNA, 32 nt, Human
uuguuuuaaagucaucuuuacuuucccaaaug

SEQ ID NO: 543456 - RNA, 32 nt, Human
uuguuuuaaauacuugagccuuuuucucggug

SEQ ID NO: 543457 - RNA, 23 nt, Human
uuguuuuaaccuccccucucccc

SEQ ID NO: 543458 - RNA, 32 nt, Human
uuguuuuacacguagcccacugccucauuaua

SEQ ID NO: 543459 - RNA, 23 nt, Human
uuguuuuagucauuuucuuugca

SEQ ID NO: 543460 - RNA, 23 nt, Human
uuguuuuauaaccaauucauuaa

SEQ ID NO: 543461 - RNA, 22 nt, Human
uuguuuuaugaaucauacacua

SEQ ID NO: 543462 - RNA, 32 nt, Human
uuguuuuaugauaaaggaagugugugauuucc

SEQ ID NO: 543463 - RNA, 28 nt, Human
uuguuuuauuaaaaauaauuagugaaag

SEQ ID NO: 543464 - RNA, 23 nt, Human
uuguuuuauuugucccucucccc

SEQ ID NO: 543465 - RNA, 32 nt, Human
uuguuuucaacuuuucauuuggauguuuggcg

SEQ ID NO: 543466 - RNA, 32 nt, Human
uuguuuucaaugccagugggccaaauauaugg

SEQ ID NO: 543467 - RNA, 32 nt, Human
uuguuuucacucgucuaucauaggcaccuucu

SEQ ID NO: 543468 - RNA, 32 nt, Human
uuguuuuccccucaccucacagugccuaugug

SEQ ID NO: 543469 - RNA, 32 nt, Human
uuguuuucccuuccccauuuccuuccuucccu

SEQ ID NO: 543470 - RNA, 32 nt, Human
uuguuuuccucccucuccucuggcugcuacaa

SEQ ID NO: 543471 - RNA, 32 nt, Human
uuguuuuccugccgcaggaacgcuaggcaguc

SEQ ID NO: 543472 - RNA, 32 nt, Human
uuguuuucuaagcauuguggcuucucaguggc

SEQ ID NO: 543473 - RNA, 32 nt, Human
uuguuuucuaagcuuacuaucuuguguuuguu

SEQ ID NO: 543474 - RNA, 32 nt, Human
uuguuuucuauauucacaauaucuuaaaaggc

SEQ ID NO: 543475 - RNA, 32 nt, Human
uuguuuucuccucugcuuggagaguuugcccu

SEQ ID NO: 543476 - RNA, 32 nt, Human
uuguuuucucugauggacaaaggcaggggacc

SEQ ID NO: 543477 - RNA, 32 nt, Human
uuguuuucugagauggagucuugcugugucac

SEQ ID NO: 543478 - RNA, 32 nt, Human
uuguuuucuuaaaaucagcagcuauuuagcgu

SEQ ID NO: 543479 - RNA, 32 nt, Human
uuguuuucuuucagaguuuccuccuucaaaaa

SEQ ID NO: 543480 - RNA, 32 nt, Human
uuguuuucuuucuccuccaugugucuuggcag

SEQ ID NO: 543481 - RNA, 23 nt, Human
uuguuuucuuuuucugucuugua

SEQ ID NO: 543482 - RNA, 23 nt, Human
uuguuuugaaaaacaguggggug

SEQ ID NO: 543483 - RNA, 32 nt, Human
uuguuuugccuuuuuaaauuacaucuccaagu

SEQ ID NO: 543484 - RNA, 32 nt, Human
uuguuuugcuucuguaaguuugccuauaaaaa

SEQ ID NO: 543485 - RNA, 32 nt, Human
uuguuuuggcaucauccucaucauguuguauu

SEQ ID NO: 543486 - RNA, 29 nt, Human
uuguuuuggcugcucuccaucucuuguac

SEQ ID NO: 543487 - RNA, 32 nt, Human
uuguuuugucauugcuugcucuggcugugucu

SEQ ID NO: 543488 - RNA, 32 nt, Human
uuguuuuguccaugccuuccucccugcacgca

SEQ ID NO: 543489 - RNA, 32 nt, Human
uuguuuugucuuagccacaagaauuccgaggu

SEQ ID NO: 543490 - RNA, 23 nt, Human
uuguuuuguuucguucuggguca

SEQ ID NO: 543491 - RNA, 25 nt, Human
uuguuuuguuuuguuuuguuuugca

SEQ ID NO: 543492 - RNA, 32 nt, Human
uuguuuuguuuuucugagacaaggucuuacuc

SEQ ID NO: 543493 - RNA, 22 nt, Human
uuguuuuguuuuucuguuuugu

SEQ ID NO: 543494 - RNA, 32 nt, Human
uuguuuuuagagucagucauuggcuuugucau

SEQ ID NO: 543495 - RNA, 32 nt, Human
uuguuuuuaggcaauucuggcuggccugagaa

SEQ ID NO: 543496 - RNA, 32 nt, Human
uuguuuuuagucucuugugcugugccuagugg

SEQ ID NO: 543497 - RNA, 32 nt, Human
uuguuuuuaucaauaaauacuuguugauugug

SEQ ID NO: 543498 - RNA, 32 nt, Human
uuguuuuuauugcagccauauccacuuaucca

SEQ ID NO: 543499 - RNA, 32 nt, Human
uuguuuuucaaaugucaccaauaaaaguuuug

SEQ ID NO: 543500 - RNA, 31 nt, Human
uuguuuuucaauaaauauuuugaaacauguu

SEQ ID NO: 543501 - RNA, 32 nt, Human
uuguuuuucccaaguucucuguucuggauuuu

SEQ ID NO: 543502 - RNA, 23 nt, Human
uuguuuuuccccaguuggcugaa

SEQ ID NO: 543503 - RNA, 32 nt, Human
uuguuuuuccccucucccuccugcuuucuuuu

SEQ ID NO: 543504 - RNA, 32 nt, Human
uuguuuuuccuccucuccuuuuccugccgccu

SEQ ID NO: 543505 - RNA, 32 nt, Human
uuguuuuuccugcuguugauuguuacuagugg

SEQ ID NO: 543506 - RNA, 32 nt, Human
uuguuuuucucuucgcuucaggcccuuacaca

SEQ ID NO: 543507 - RNA, 32 nt, Human
uuguuuuugagacaagagucucgcucugucac

SEQ ID NO: 543508 - RNA, 32 nt, Human
uuguuuuugagaccauugcauucuggcugguu

SEQ ID NO: 543509 - RNA, 32 nt, Human
uuguuuuugccuggcucucagguugcuucuga

SEQ ID NO: 543510 - RNA, 32 nt, Human
uuguuuuugcuuguaaucucacugagccaaau

SEQ ID NO: 543511 - RNA, 23 nt, Human
uuguuuuugggggcuaauuggug

SEQ ID NO: 543512 - RNA, 32 nt, Human
uuguuuuugucacuugccccagcagagcaggg

SEQ ID NO: 543513 - RNA, 32 nt, Human
uuguuuuugucccuuucuuggaaauguuaaug

SEQ ID NO: 543514 - RNA, 20 nt, Human
uuguuuuuguugcugagcca

SEQ ID NO: 543515 - RNA, 21 nt, Human
uuguuuuuuaauaauguggua

SEQ ID NO: 543516 - RNA, 23 nt, Human
uuguuuuuugcuaccucuuccuc

SEQ ID NO: 543517 - RNA, 32 nt, Human
uuuaaaaacacaaaucuaagccuugacgguuu

SEQ ID NO: 543518 - RNA, 32 nt, Human
uuuaaaaacagcacuggcuggggcauucucau

SEQ ID NO: 543519 - RNA, 32 nt, Human
uuuaaaaacauguacugagaugaaucuaauuu

SEQ ID NO: 543520 - RNA, 32 nt, Human
uuuaaaaagaacaugccacgauuuugucuuuc

SEQ ID NO: 543521 - RNA, 32 nt, Human
uuuaaaaagaacgaagcuggaggacucacacu

SEQ ID NO: 543522 - RNA, 32 nt, Human
uuuaaaaagaugauugcuggucuuaacuuuag

SEQ ID NO: 543523 - RNA, 30 nt, Human
uuuaaaaagcccuccaugcuauuuugauga

SEQ ID NO: 543524 - RNA, 32 nt, Human
uuuaaaaaggaaggaaggagcaagugaaguuu

SEQ ID NO: 543525 - RNA, 32 nt, Human
uuuaaaaaggggagaugagaaagggaauacua

SEQ ID NO: 543526 - RNA, 32 nt, Human
uuuaaaaaguacucaaugaaguugcccucagg

SEQ ID NO: 543527 - RNA, 32 nt, Human
uuuaaaaagugagaaauggggaaaagaagagg

SEQ ID NO: 543528 - RNA, 32 nt, Human
uuuaaaaaguuagccagguaugguggcauaua

SEQ ID NO: 543529 - RNA, 31 nt, Human
uuuaaaaauaaagggcuuucacugggcauga

SEQ ID NO: 543530 - RNA, 32 nt, Human
uuuaaaaauagguuuuuaaagcuuucauuuuu

SEQ ID NO: 543531 - RNA, 32 nt, Human
uuuaaaaaucacccucuacuuguucuccugug

SEQ ID NO: 543532 - RNA, 32 nt, Human
uuuaaaaauccgccacaccauccaucagaauc

SEQ ID NO: 543533 - RNA, 32 nt, Human
uuuaaaaaucuuguaccuagcacaguauuguu

SEQ ID NO: 543534 - RNA, 32 nt, Human
uuuaaaaauuagccgggcaaugguggcgccug

SEQ ID NO: 543535 - RNA, 32 nt, Human
uuuaaaaauuagccuugauauucuccagacca

SEQ ID NO: 543536 - RNA, 32 nt, Human
uuuaaaaauuguacuucagaacaucagauuuu

SEQ ID NO: 543537 - RNA, 32 nt, Human
uuuaaaaauuguuguuuauuugccaaagucaa

SEQ ID NO: 543538 - RNA, 32 nt, Human
uuuaaaaauuuagcuggguguggugguacgug

SEQ ID NO: 543539 - RNA, 32 nt, Human
uuuaaaacaaaggccugugcuccacccaggag

SEQ ID NO: 543540 - RNA, 32 nt, Human
uuuaaaacaaccauugcauguuugcuuuugau

SEQ ID NO: 543541 - RNA, 32 nt, Human
uuuaaaacaagaaaguuuccccaccagugaau

SEQ ID NO: 543542 - RNA, 32 nt, Human
uuuaaaacacacacauacacacacaaaacaau

SEQ ID NO: 543543 - RNA, 32 nt, Human
uuuaaaacacagauaugaugguccuugcugca

SEQ ID NO: 543544 - RNA, 32 nt, Human
uuuaaaacagaagugaaaccacgggugcuuug

SEQ ID NO: 543545 - RNA, 32 nt, Human
uuuaaaacagagggaagaauauacagauugaa

SEQ ID NO: 543546 - RNA, 32 nt, Human
uuuaaaacagcccaguauuccuuuguauccuc

SEQ ID NO: 543547 - RNA, 32 nt, Human
uuuaaaacauaaauagcuuggaacacccugaa

SEQ ID NO: 543548 - RNA, 31 nt, Human
uuuaaaacauaaugccuacuugauuuauauc

SEQ ID NO: 543549 - RNA, 32 nt, Human
uuuaaaacaucauaggccagggccccucaccc

SEQ ID NO: 543550 - RNA, 23 nt, Human
uuuaaaacaugaauugcucgaca

SEQ ID NO: 543551 - RNA, 32 nt, Human
uuuaaaaccacagccaugaacagacguugggg

SEQ ID NO: 543552 - RNA, 32 nt, Human
uuuaaaaccagcacaagcaaaugaguaucaca

SEQ ID NO: 543553 - RNA, 32 nt, Human
uuuaaaacucccagacacgcacugccugugca

SEQ ID NO: 543554 - RNA, 32 nt, Human
uuuaaaacuugcuuuguuuagaauucccaccu

SEQ ID NO: 543555 - RNA, 32 nt, Human
uuuaaaacuuucuaacaauauagucuuuggau

SEQ ID NO: 543556 - RNA, 32 nt, Human
uuuaaaagaaaauaggggcacaggcuguugag

SEQ ID NO: 543557 - RNA, 32 nt, Human
uuuaaaagacagggucccuauucuuuaguuau

SEQ ID NO: 543558 - RNA, 32 nt, Human
uuuaaaagaccaugacgaauguguacacagaa

SEQ ID NO: 543559 - RNA, 32 nt, Human
uuuaaaagacucagucuaggcuugccuuugca

SEQ ID NO: 543560 - RNA, 32 nt, Human
uuuaaaagacuuuuaaaauauguguuuucauu

SEQ ID NO: 543561 - RNA, 32 nt, Human
uuuaaaagagcaggccaggcgcgguggcucac

SEQ ID NO: 543562 - RNA, 32 nt, Human
uuuaaaagaggucucuaacugaagagagaugg

SEQ ID NO: 543563 - RNA, 32 nt, Human
uuuaaaagcaccugacuagcauguguucuuga

SEQ ID NO: 543564 - RNA, 32 nt, Human
uuuaaaagcccagauuuccggccagguguggu

SEQ ID NO: 543565 - RNA, 32 nt, Human
uuuaaaagcccccaaagaagcuucuguuuugg

SEQ ID NO: 543566 - RNA, 32 nt, Human
uuuaaaagcccccaaggaaggaggcugggacu

SEQ ID NO: 543567 - RNA, 30 nt, Human
uuuaaaagccucucaaugcguccucgaccu

SEQ ID NO: 543568 - RNA, 32 nt, Human
uuuaaaagcuucaaaaugaugggauaugauca

SEQ ID NO: 543569 - RNA, 32 nt, Human
uuuaaaaggaaaagaauaaguauucuugcauc

SEQ ID NO: 543570 - RNA, 32 nt, Human
uuuaaaaggagagaggaggggugauggcaggg

SEQ ID NO: 543571 - RNA, 32 nt, Human
uuuaaaaggccuccaauacucuuauggagccu

SEQ ID NO: 543572 - RNA, 32 nt, Human
uuuaaaaggccugaacuauacuuugaagaaac

SEQ ID NO: 543573 - RNA, 32 nt, Human
uuuaaaaggcuggaggcaagguggugacaggc

SEQ ID NO: 543574 - RNA, 32 nt, Human
uuuaaaagguacuguacaaccauuauaucugu

SEQ ID NO: 543575 - RNA, 32 nt, Human
uuuaaaagguauaaaucaaaauaacaaauuau

SEQ ID NO: 543576 - RNA, 32 nt, Human
uuuaaaagguuuucccuuuucugaucugcauu

SEQ ID NO: 543577 - RNA, 32 nt, Human
uuuaaaagugucacucuuccuccuuuucuacu

SEQ ID NO: 543578 - RNA, 32 nt, Human
uuuaaaaguucuguugcuuguauuaacacgaa

SEQ ID NO: 543579 - RNA, 32 nt, Human
uuuaaaauaucuugagguauuuugccacuggc

SEQ ID NO: 543580 - RNA, 32 nt, Human
uuuaaaauauguuccugauuguacauauugua

SEQ ID NO: 543581 - RNA, 32 nt, Human
uuuaaaaucacuucucuggccucugguuucuc

SEQ ID NO: 543582 - RNA, 32 nt, Human
uuuaaaauccuucguagggaaggacagcuguc

SEQ ID NO: 543583 - RNA, 32 nt, Human
uuuaaaaucuuaaaauguuucuuauuuucagc

SEQ ID NO: 543584 - RNA, 32 nt, Human
uuuaaaaucuuccuacacacaucuagacguuc

SEQ ID NO: 543585 - RNA, 32 nt, Human
uuuaaaaugagacaggcuacccuucgggaguc

SEQ ID NO: 543586 - RNA, 32 nt, Human
uuuaaaaugcagcaggaggagaggugaagaca

SEQ ID NO: 543587 - RNA, 32 nt, Human
uuuaaaaugggaaauacuuuuuaaguuauuca

SEQ ID NO: 543588 - RNA, 32 nt, Human
uuuaaaaugguaauaacaguaccaccuaauag

SEQ ID NO: 543589 - RNA, 32 nt, Human
uuuaaaauguacauuauaaccuguaugguauu

SEQ ID NO: 543590 - RNA, 32 nt, Human
uuuaaaauguguuuguuggaggucauuaacgu

SEQ ID NO: 543591 - RNA, 32 nt, Human
uuuaaaauguucagguagcagugagcauuguu

SEQ ID NO: 543592 - RNA, 32 nt, Human
uuuaaaauuuucaauucuuugaucucaugcaa

SEQ ID NO: 543593 - RNA, 32 nt, Human
uuuaaacaaaaauaggaaacuuagauguaacu

SEQ ID NO: 543594 - RNA, 32 nt, Human
uuuaaacaaccagggacccucugccccuagaa

SEQ ID NO: 543595 - RNA, 32 nt, Human
uuuaaacacaaaccaaauacuccaggguuuug

SEQ ID NO: 543596 - RNA, 32 nt, Human
uuuaaacacaucagugcuuccacauucaccua

SEQ ID NO: 543597 - RNA, 32 nt, Human
uuuaaacacgucaucaauucauugccugcagc

SEQ ID NO: 543598 - RNA, 32 nt, Human
uuuaaacacugaagugccgaaguggcccgugc

SEQ ID NO: 543599 - RNA, 32 nt, Human
uuuaaacacuguugcauguuguaauaucaggu

SEQ ID NO: 543600 - RNA, 32 nt, Human
uuuaaacagaacuucauuccccguugaacuuu

SEQ ID NO: 543601 - RNA, 32 nt, Human
uuuaaacagcugacauuugggcaauuugagua

SEQ ID NO: 543602 - RNA, 22 nt, Human
uuuaaacauauggcaucucuca

SEQ ID NO: 543603 - RNA, 32 nt, Human
uuuaaacauguaaaaguauggaaguacaucca

SEQ ID NO: 543604 - RNA, 24 nt, Human
uuuaaacauuuauguuuaaaagua

SEQ ID NO: 543605 - RNA, 32 nt, Human
uuuaaaccagagaagauggaguucuaaaagua

SEQ ID NO: 543606 - RNA, 32 nt, Human
uuuaaaccagccugggcaccauggugagaccc

SEQ ID NO: 543607 - RNA, 32 nt, Human
uuuaaaccaguaguucuuuaauuuacgggucu

SEQ ID NO: 543608 - RNA, 32 nt, Human
uuuaaaccauuccacccggcaguauucagcuu

SEQ ID NO: 543609 - RNA, 32 nt, Human
uuuaaacccaggaggcagagguugcagugagu

SEQ ID NO: 543610 - RNA, 32 nt, Human
uuuaaacccuaccugugugauucaguaggguu

SEQ ID NO: 543611 - RNA, 32 nt, Human
uuuaaaccggucuuuuggggcugcaguaaaaa

SEQ ID NO: 543612 - RNA, 32 nt, Human
uuuaaaccuccccuccucuccuccuuucaccu

SEQ ID NO: 543613 - RNA, 32 nt, Human
uuuaaaccucucuauucccugccauaacaucu

SEQ ID NO: 543614 - RNA, 32 nt, Human
uuuaaaccugaacauugaaacaguuuuccucc

SEQ ID NO: 543615 - RNA, 32 nt, Human
uuuaaaccuuggaaggugaaaauguacaaacu

SEQ ID NO: 543616 - RNA, 32 nt, Human
uuuaaacgcagauagagaguucagaguugaug

SEQ ID NO: 543617 - RNA, 32 nt, Human
uuuaaacgcuguugcauguuguaauaccaggu

SEQ ID NO: 543618 - RNA, 32 nt, Human
uuuaaacuaggagaaccaaaucuggaagccaa

SEQ ID NO: 543619 - RNA, 32 nt, Human
uuuaaacuauguuuuucagcccuucagaaggg

SEQ ID NO: 543620 - RNA, 32 nt, Human
uuuaaacucaaagggaagccuuaucuguggcu

SEQ ID NO: 543621 - RNA, 32 nt, Human
uuuaaacucauuuucucugcuugaauacacaa

SEQ ID NO: 543622 - RNA, 32 nt, Human
uuuaaacucauuuuugccauacaucaguuauu

SEQ ID NO: 543623 - RNA, 32 nt, Human
uuuaaacucuccccgucauuuccaaauauuuc

SEQ ID NO: 543624 - RNA, 32 nt, Human
uuuaaacugcaaugccaguccugcaggagugc

SEQ ID NO: 543625 - RNA, 32 nt, Human
uuuaaacuggcggugccaguugcagugaaggu

SEQ ID NO: 543626 - RNA, 32 nt, Human
uuuaaacuguauaauggagcuagauacaagca

SEQ ID NO: 543627 - RNA, 20 nt, Human
uuuaaacuguauuuaccagu

SEQ ID NO: 543628 - RNA, 32 nt, Human
uuuaaacuucucuauucccugccauaacaucu

SEQ ID NO: 543629 - RNA, 32 nt, Human
uuuaaacuuggggaagauuaagaaaagaacca

SEQ ID NO: 543630 - RNA, 32 nt, Human
uuuaaacuuugccaugaacuccugggcuuugg

SEQ ID NO: 543631 - RNA, 32 nt, Human
uuuaaagaaaaaugaaaaagguuaguguuugg

SEQ ID NO: 543632 - RNA, 32 nt, Human
uuuaaagaaagccacacagagcugaaucgggc

SEQ ID NO: 543633 - RNA, 32 nt, Human
uuuaaagaaagccucagacaguaagggcuuuu

SEQ ID NO: 543634 - RNA, 32 nt, Human
uuuaaagaauccagauauuuuacugcaaaagu

SEQ ID NO: 543635 - RNA, 32 nt, Human
uuuaaagacacgauuccucagaccagugagca

SEQ ID NO: 543636 - RNA, 32 nt, Human
uuuaaagacugagccaagucaccuccagggca

SEQ ID NO: 543637 - RNA, 32 nt, Human
uuuaaagagaaaaguacaagacagaaaucuuc

SEQ ID NO: 543638 - RNA, 32 nt, Human
uuuaaagagaagcagacugacuuuggaaaggg

SEQ ID NO: 543639 - RNA, 32 nt, Human
uuuaaagagacaccucuggaccugcagcaccg

SEQ ID NO: 543640 - RNA, 32 nt, Human
uuuaaagagacaccucuggaccugcugcaccg

SEQ ID NO: 543641 - RNA, 32 nt, Human
uuuaaagagacacugucccacuccaucaccca

SEQ ID NO: 543642 - RNA, 32 nt, Human
uuuaaagauagaauuuguuuacauucucugga

SEQ ID NO: 543643 - RNA, 32 nt, Human
uuuaaagaucucggugcugaacgacaguccca

SEQ ID NO: 543644 - RNA, 32 nt, Human
uuuaaagauggaacucacccuuugcuugguuu

SEQ ID NO: 543645 - RNA, 32 nt, Human
uuuaaagauggaacuccacccuuugcuugguu

SEQ ID NO: 543646 - RNA, 32 nt, Human
uuuaaagauuuacacagauuugaauagcagug

SEQ ID NO: 543647 - RNA, 32 nt, Human
uuuaaagauuuuuagugcaauggcacgguaac

SEQ ID NO: 543648 - RNA, 32 nt, Human
uuuaaagcaaaauggggauugaagggacuuau

SEQ ID NO: 543649 - RNA, 32 nt, Human
uuuaaagcacacuguaauaauaaaugcaauua

SEQ ID NO: 543650 - RNA, 32 nt, Human
uuuaaagcauuguaugauuccacccauggcaa

SEQ ID NO: 543651 - RNA, 32 nt, Human
uuuaaagccaaugagcccccaacagagcucuu

SEQ ID NO: 543652 - RNA, 32 nt, Human
uuuaaagccaucaucuuaucuucuagcuguac

SEQ ID NO: 543653 - RNA, 32 nt, Human
uuuaaagccauggaacaaaaccugauacauca

SEQ ID NO: 543654 - RNA, 32 nt, Human
uuuaaagcccuucugaugauuccaauguguug

SEQ ID NO: 543655 - RNA, 32 nt, Human
uuuaaagcuagcaauaaaugcuaugcagaaaa

SEQ ID NO: 543656 - RNA, 32 nt, Human
uuuaaagcugggugucugggggagacaucaca

SEQ ID NO: 543657 - RNA, 32 nt, Human
uuuaaagcuguggaaaagcagagcccuagaag

SEQ ID NO: 543658 - RNA, 32 nt, Human
uuuaaagcuuaaguuuuaucguguaaauacau

SEQ ID NO: 543659 - RNA, 32 nt, Human
uuuaaagcuuacccuugguuugcacauaaaac

SEQ ID NO: 543660 - RNA, 32 nt, Human
uuuaaagcuuuuccuuuuuagguuggagaagg

SEQ ID NO: 543661 - RNA, 32 nt, Human
uuuaaagcuuuugcacccaugccuucacuuca

SEQ ID NO: 543662 - RNA, 32 nt, Human
uuuaaaggaaaaucacaucuccaggcuuucaa

SEQ ID NO: 543663 - RNA, 32 nt, Human
uuuaaaggaaaggaaagagggagccaaaguag

SEQ ID NO: 543664 - RNA, 32 nt, Human
uuuaaaggaacagcacuucuuagcuguucaca

SEQ ID NO: 543665 - RNA, 32 nt, Human
uuuaaaggaagccacaugaaaauugaguuugg

SEQ ID NO: 543666 - RNA, 32 nt, Human
uuuaaaggagaaagcuuauuauggaaagucac

SEQ ID NO: 543667 - RNA, 32 nt, Human
uuuaaaggaguaaugggaauccuucaacuaca

SEQ ID NO: 543668 - RNA, 32 nt, Human
uuuaaaggagugagccagucacccaggagaau

SEQ ID NO: 543669 - RNA, 31 nt, Human
uuuaaaggcaugucuccagugcugagcauga

SEQ ID NO: 543670 - RNA, 32 nt, Human
uuuaaaggccacccucuccagccccuuguccc

SEQ ID NO: 543671 - RNA, 32 nt, Human
uuuaaaggcccagccccuagaaacccaagcuc

SEQ ID NO: 543672 - RNA, 32 nt, Human
uuuaaagggaacaugugaaugaauacacagga

SEQ ID NO: 543673 - RNA, 32 nt, Human
uuuaaagggcccucugcuggcugaguggcaau

SEQ ID NO: 543674 - RNA, 32 nt, Human
uuuaaagggcuccaaucagggauuugcaggag

SEQ ID NO: 543675 - RNA, 32 nt, Human
uuuaaaggggugagccaccgcacccaguccug

SEQ ID NO: 543676 - RNA, 32 nt, Human
uuuaaagguaggguccagaagagucauauaua

SEQ ID NO: 543677 - RNA, 32 nt, Human
uuuaaaguaagcaugucuuaccuucacuuagc

SEQ ID NO: 543678 - RNA, 32 nt, Human
uuuaaaguaaguauggauuauggaagucuagu

SEQ ID NO: 543679 - RNA, 32 nt, Human
uuuaaaguaauauuucuuucuaauauaauauu

SEQ ID NO: 543680 - RNA, 32 nt, Human
uuuaaaguagcuugacuuuuucugcuaguguu

SEQ ID NO: 543681 - RNA, 32 nt, Human
uuuaaagucaucucuucagcaauccagagguu

SEQ ID NO: 543682 - RNA, 32 nt, Human
uuuaaagucgcugaucauccucuuccucaucu

SEQ ID NO: 543683 - RNA, 32 nt, Human
uuuaaaguuaacuaacagcuguaguuugcuuu

SEQ ID NO: 543684 - RNA, 32 nt, Human
uuuaaaguuaguaucuacagauggaauuguau

SEQ ID NO: 543685 - RNA, 32 nt, Human
uuuaaauaaagcaguuuuuaaaacuacuguug

SEQ ID NO: 543686 - RNA, 32 nt, Human
uuuaaauaagagggugaaggggaaccagagcg

SEQ ID NO: 543687 - RNA, 32 nt, Human
uuuaaauaagcauuaacuaacaaccuuucuau

SEQ ID NO: 543688 - RNA, 32 nt, Human
uuuaaauacauacuuauguuuguauuaaucua

SEQ ID NO: 543689 - RNA, 32 nt, Human
uuuaaauacauuuaauaugucauuuuaaaaau

SEQ ID NO: 543690 - RNA, 32 nt, Human
uuuaaauaccccuuucuaguaaugccaaagac

SEQ ID NO: 543691 - RNA, 32 nt, Human
uuuaaauacuauauguaucucauguacaaagu

SEQ ID NO: 543692 - RNA, 32 nt, Human
uuuaaauacuuuccuggcugggcgugguggcu

SEQ ID NO: 543693 - RNA, 32 nt, Human
uuuaaauagcuuuuugcuauaugauaauauag

SEQ ID NO: 543694 - RNA, 32 nt, Human
uuuaaauaggacacaucucccuauguuuaacu

SEQ ID NO: 543695 - RNA, 32 nt, Human
uuuaaauaguugguugaagaagaugaggcacu

SEQ ID NO: 543696 - RNA, 32 nt, Human
uuuaaauauauguacacacgcauguacacaca

SEQ ID NO: 543697 - RNA, 32 nt, Human
uuuaaauauccaggugugccccuccaagucac

SEQ ID NO: 543698 - RNA, 32 nt, Human
uuuaaauauuuuuaagauaauguauauugauu

SEQ ID NO: 543699 - RNA, 32 nt, Human
uuuaaaucaaauacaguuauuuuaguuacagg

SEQ ID NO: 543700 - RNA, 32 nt, Human
uuuaaaucacauaaaaagccaaucuacucuuc

SEQ ID NO: 543701 - RNA, 32 nt, Human
uuuaaaucagauuggaagacauggacaaauca

SEQ ID NO: 543702 - RNA, 32 nt, Human
uuuaaaucagcccuguuaguaggaauguggcu

SEQ ID NO: 543703 - RNA, 32 nt, Human
uuuaaaucagcuguuucauguauuagccuugc

SEQ ID NO: 543704 - RNA, 32 nt, Human
uuuaaauccacucuaaaccuucccucuaagug

SEQ ID NO: 543705 - RNA, 32 nt, Human
uuuaaaucuccuccucuucuuccuguccaugc

SEQ ID NO: 543706 - RNA, 32 nt, Human
uuuaaaucugaacaaucccacagggaaaucag

SEQ ID NO: 543707 - RNA, 32 nt, Human
uuuaaaucugaacaauccuacagggaaaucag

SEQ ID NO: 543708 - RNA, 32 nt, Human
uuuaaaucuuccugggucccaaggaauuagaa

SEQ ID NO: 543709 - RNA, 32 nt, Human
uuuaaaugaaaaauuccuauguucaguagcgu

SEQ ID NO: 543710 - RNA, 32 nt, Human
uuuaaaugaacaaguaaccacaucucaggcgg

SEQ ID NO: 543711 - RNA, 32 nt, Human
uuuaaaugcauucaucauuugacaguguucuc

SEQ ID NO: 543712 - RNA, 32 nt, Human
uuuaaaugcugaacuguuacacaugcuugauu

SEQ ID NO: 543713 - RNA, 32 nt, Human
uuuaaaugcugaacuguuacacaugcuuguuu

SEQ ID NO: 543714 - RNA, 32 nt, Human
uuuaaauggaaaggagaaugacagcaaagccu

SEQ ID NO: 543715 - RNA, 32 nt, Human
uuuaaauggaguuauuuguagguccuuucuua

SEQ ID NO: 543716 - RNA, 32 nt, Human
uuuaaaugggagaaagaaagagauugacauuu

SEQ ID NO: 543717 - RNA, 32 nt, Human
uuuaaaugguugaaaaaggaaaaagaauguuu

SEQ ID NO: 543718 - RNA, 32 nt, Human
uuuaaauguacaccugauuugagaagcugaag

SEQ ID NO: 543719 - RNA, 32 nt, Human
uuuaaauguguucauguacaguccccaucagu

SEQ ID NO: 543720 - RNA, 32 nt, Human
uuuaaauuaaagaaauaucauuauggaacacu

SEQ ID NO: 543721 - RNA, 32 nt, Human
uuuaaauuaaagcaaaguaaauaaaaguacaa

SEQ ID NO: 543722 - RNA, 32 nt, Human
uuuaaauuaacuuauuuuguagaagacaaaau

SEQ ID NO: 543723 - RNA, 32 nt, Human
uuuaaauuaaggcuuuuaaaauagaaagcuga

SEQ ID NO: 543724 - RNA, 32 nt, Human
uuuaaauuaauuuuuaauucuuuuggcaaguu

SEQ ID NO: 543725 - RNA, 32 nt, Human
uuuaaauuaggaaaaagcugaagguucaaaca

SEQ ID NO: 543726 - RNA, 32 nt, Human
uuuaaauuaguaucccugccuaggugaaaagu

SEQ ID NO: 543727 - RNA, 32 nt, Human
uuuaaauuaguggaaaaguauguguggagaug

SEQ ID NO: 543728 - RNA, 23 nt, Human
uuuaaauucacuuguagccugga

SEQ ID NO: 543729 - RNA, 32 nt, Human
uuuaaauucccauuccaccacagugccccuca

SEQ ID NO: 543730 - RNA, 32 nt, Human
uuuaaauucuggagaaauaagauagaaagaaa

SEQ ID NO: 543731 - RNA, 32 nt, Human
uuuaaauucuuacacugacucuuccaaagucu

SEQ ID NO: 543732 - RNA, 32 nt, Human
uuuaaauucuuuuugugaccucagaaugucuc

SEQ ID NO: 543733 - RNA, 32 nt, Human
uuuaaauugcagccauuuccuaggcaacuucu

SEQ ID NO: 543734 - RNA, 32 nt, Human
uuuaaauugccugccaugccucuuuuccucca

SEQ ID NO: 543735 - RNA, 32 nt, Human
uuuaaauuggggacugugugugcuggugugug

SEQ ID NO: 543736 - RNA, 23 nt, Human
uuuaaauuuaccuauagccugga

SEQ ID NO: 543737 - RNA, 24 nt, Human
uuuaaauuuagauguucaaaagua

SEQ ID NO: 543738 - RNA, 23 nt, Human
uuuaaauuuaguguacaaaugua

SEQ ID NO: 543739 - RNA, 32 nt, Human
uuuaaauuucagacugauauauucccaguauu

SEQ ID NO: 543740 - RNA, 23 nt, Human
uuuaaauuugcuauuucaaaagu

SEQ ID NO: 543741 - RNA, 32 nt, Human
uuuaaauuuucccuaaacaauggaaguacaug

SEQ ID NO: 543742 - RNA, 32 nt, Human
uuuaaauuuugaaaucuaaacauucuuuccca

SEQ ID NO: 543743 - RNA, 23 nt, Human
uuuaacaaaacuaaucuaaaaaa

SEQ ID NO: 543744 - RNA, 32 nt, Human
uuuaacaaaaggccaccuuuaaccuuuaacaa

SEQ ID NO: 543745 - RNA, 32 nt, Human
uuuaacaaacuaaggcagaaauacuaaaaaua

SEQ ID NO: 543746 - RNA, 32 nt, Human
uuuaacaaagagaggaaggagaagugaggaag

SEQ ID NO: 543747 - RNA, 32 nt, Human
uuuaacaagacuuggaacaugugcaaauggaa

SEQ ID NO: 543748 - RNA, 32 nt, Human
uuuaacaaucaccucagaugacuuugauguua

SEQ ID NO: 543749 - RNA, 32 nt, Human
uuuaacacacagacccaagauucauacuauua

SEQ ID NO: 543750 - RNA, 32 nt, Human
uuuaacacaccuagaggcugggcauaguagcu

SEQ ID NO: 543751 - RNA, 32 nt, Human
uuuaacacagccguguguucaaauguacagug

SEQ ID NO: 543752 - RNA, 32 nt, Human
uuuaacacccagcccagugguucuuucauaga

SEQ ID NO: 543753 - RNA, 32 nt, Human
uuuaacaccgcagaacccccucccagaagaag

SEQ ID NO: 543754 - RNA, 32 nt, Human
uuuaacacuaguauuuguuaaaugggguauuu

SEQ ID NO: 543755 - RNA, 32 nt, Human
uuuaacacugcauuuccccaaggaggcgggug

SEQ ID NO: 543756 - RNA, 32 nt, Human
uuuaacacuuggcucaaaccucuaggucauac

SEQ ID NO: 543757 - RNA, 32 nt, Human
uuuaacagaaacaaacagcccaaauuacuuua

SEQ ID NO: 543758 - RNA, 32 nt, Human
uuuaacagaaaugcuaauaaccuacugggaaa

SEQ ID NO: 543759 - RNA, 32 nt, Human
uuuaacagauagaguguggcuucauuugucca

SEQ ID NO: 543760 - RNA, 32 nt, Human
uuuaacagauuuuguauauacacacacaaguu

SEQ ID NO: 543761 - RNA, 32 nt, Human
uuuaacaggacuuuuuauuggaacaauguacu

SEQ ID NO: 543762 - RNA, 32 nt, Human
uuuaacaguaauuccagccacaaucuuuagau

SEQ ID NO: 543763 - RNA, 32 nt, Human
uuuaacauaugaauuucuggggugggguuggg

SEQ ID NO: 543764 - RNA, 32 nt, Human
uuuaacaucaaaacaacaugcaaccaaaaacu

SEQ ID NO: 543765 - RNA, 32 nt, Human
uuuaacaucagccugggcaacauagcaggacc

SEQ ID NO: 543766 - RNA, 32 nt, Human
uuuaacaugccccugugaacagguauuuucag

SEQ ID NO: 543767 - RNA, 21 nt, Human
uuuaacaugucguguuuucga

SEQ ID NO: 543768 - RNA, 32 nt, Human
uuuaacauguuacugaagcauuugaauauaaa

SEQ ID NO: 543769 - RNA, 32 nt, Human
uuuaacauuaagugccuuugguucagaggggc

SEQ ID NO: 543770 - RNA, 32 nt, Human
uuuaacauucacauugcccugccucugucccc

SEQ ID NO: 543771 - RNA, 32 nt, Human
uuuaacauuuccucuuuccaagaccaaccuac

SEQ ID NO: 543772 - RNA, 32 nt, Human
uuuaaccaaaaggaaaucaucuggaagcagga

SEQ ID NO: 543773 - RNA, 32 nt, Human
uuuaaccacuugaacgcggaaguggcuuuccu

SEQ ID NO: 543774 - RNA, 32 nt, Human
uuuaaccagguacugucuaacaacagucaucu

SEQ ID NO: 543775 - RNA, 32 nt, Human
uuuaaccauggcgucccucuucaagaagagaa

SEQ ID NO: 543776 - RNA, 32 nt, Human
uuuaaccauguuggccaggauggucucgaucu

SEQ ID NO: 543777 - RNA, 32 nt, Human
uuuaaccauucccauguuguuaacuauuuagg

SEQ ID NO: 543778 - RNA, 32 nt, Human
uuuaacccagaagacaggcugcagugagccaa

SEQ ID NO: 543779 - RNA, 32 nt, Human
uuuaacccaggaggcagagguugcagugagcu

SEQ ID NO: 543780 - RNA, 20 nt, Human
uuuaacccauucaccaaaau

SEQ ID NO: 543781 - RNA, 32 nt, Human
uuuaaccccagcgcuauucauaacuuuuauga

SEQ ID NO: 543782 - RNA, 32 nt, Human
uuuaacccccgagggccuuggcugggucccag

SEQ ID NO: 543783 - RNA, 32 nt, Human
uuuaaccccuacucuguuuuacaacagaaaua

SEQ ID NO: 543784 - RNA, 32 nt, Human
uuuaacccgggagguggagguugcagugagcu

SEQ ID NO: 543785 - RNA, 32 nt, Human
uuuaacccuccccuucguguuucccccaaugu

SEQ ID NO: 543786 - RNA, 32 nt, Human
uuuaacccugcaggacuucucacgauguuuaa

SEQ ID NO: 543787 - RNA, 32 nt, Human
uuuaaccugaaccuugagcaaauuaguugguu

SEQ ID NO: 543788 - RNA, 32 nt, Human
uuuaaccugacugucuaaaaauucccagcuaa

SEQ ID NO: 543789 - RNA, 32 nt, Human
uuuaaccugcagacuucuguugacucauacuc

SEQ ID NO: 543790 - RNA, 32 nt, Human
uuuaaccugcagcugucugucugggacuggga

SEQ ID NO: 543791 - RNA, 32 nt, Human
uuuaaccuuaacuguuguuuuggacuugaacu

SEQ ID NO: 543792 - RNA, 32 nt, Human
uuuaacgaguucuuacugaucauuccacuugu

SEQ ID NO: 543793 - RNA, 32 nt, Human
uuuaacggaguaucacucugucacucaggcug

SEQ ID NO: 543794 - RNA, 32 nt, Human
uuuaacguuaaugcaccucugccuccacgaaa

SEQ ID NO: 543795 - RNA, 32 nt, Human
uuuaacguuguagggccugcccauggagcgga

SEQ ID NO: 543796 - RNA, 32 nt, Human
uuuaacuacaucugccucggcucacaaauucc

SEQ ID NO: 543797 - RNA, 32 nt, Human
uuuaacuaccugcuucccaggcguccaugaca

SEQ ID NO: 543798 - RNA, 32 nt, Human
uuuaacuacuggcaaagcacuugcauuuuuca

SEQ ID NO: 543799 - RNA, 32 nt, Human
uuuaacuauugucauuugccucuuucacauca

SEQ ID NO: 543800 - RNA, 32 nt, Human
uuuaacucaacaauaccugcuucccaauuacu

SEQ ID NO: 543801 - RNA, 32 nt, Human
uuuaacucaagacccucccaaccaaaaucgag

SEQ ID NO: 543802 - RNA, 32 nt, Human
uuuaacucagaaaaguaaagacaggaaauaac

SEQ ID NO: 543803 - RNA, 32 nt, Human
uuuaacucaggacuccagcccauugguagacg

SEQ ID NO: 543804 - RNA, 32 nt, Human
uuuaacucagguacuccagucuucaccccaac

SEQ ID NO: 543805 - RNA, 32 nt, Human
uuuaacuccuccaggguggggucugggcagug

SEQ ID NO: 543806 - RNA, 32 nt, Human
uuuaacucuugcuucauagguguaccauuuaa

SEQ ID NO: 543807 - RNA, 18 nt, Human
uuuaacugaaucuuuaca

SEQ ID NO: 543808 - RNA, 32 nt, Human
uuuaacugauguaugaauauuaauacucuaaa

SEQ ID NO: 543809 - RNA, 32 nt, Human
uuuaacugcagccuugaacacacacaaaaaua

SEQ ID NO: 543810 - RNA, 32 nt, Human
uuuaacugccacucccuguccagacuuucggu

SEQ ID NO: 543811 - RNA, 32 nt, Human
uuuaacugcuuugucaaaauuaaacauuuugu

SEQ ID NO: 543812 - RNA, 32 nt, Human
uuuaacugguaacccagccuguggcgucaguc

SEQ ID NO: 543813 - RNA, 31 nt, Human
uuuaacuggugaagagaaaaaggcugaaaag

SEQ ID NO: 543814 - RNA, 32 nt, Human
uuuaacuguauccaauguguggauguuuuaag

SEQ ID NO: 543815 - RNA, 32 nt, Human
uuuaacuguccugagcuacaucacgcccacaa

SEQ ID NO: 543816 - RNA, 32 nt, Human
uuuaacugugugaccagcggaaacaggugugu

SEQ ID NO: 543817 - RNA, 32 nt, Human
uuuaacugugugaccuugggcaagucacuuaa

SEQ ID NO: 543818 - RNA, 32 nt, Human
uuuaacugugugaugucccguuagugagaccg

SEQ ID NO: 543819 - RNA, 32 nt, Human
uuuaacuuaaagaaauuuuaacgugagaaaau

SEQ ID NO: 543820 - RNA, 32 nt, Human
uuuaacuuaacucuuaccuauuuucugcagcu

SEQ ID NO: 543821 - RNA, 32 nt, Human
uuuaacuuaccugagagugagagauguguagg

SEQ ID NO: 543822 - RNA, 32 nt, Human
uuuaacuuaggcacaggagauccacuuuuaaa

SEQ ID NO: 543823 - RNA, 32 nt, Human
uuuaacuucacugcaauucuguuucccucauu

SEQ ID NO: 543824 - RNA, 32 nt, Human
uuuaacuuccaugagccaccaugcccggcccc

SEQ ID NO: 543825 - RNA, 23 nt, Human
uuuaacuucucaguuauuuguau

SEQ ID NO: 543826 - RNA, 32 nt, Human
uuuaacuugcaguauaucacagagccacucuu

SEQ ID NO: 543827 - RNA, 32 nt, Human
uuuaacuuggauuucucguuccagaaauugug

SEQ ID NO: 543828 - RNA, 32 nt, Human
uuuaacuuuagacaacuuacuacuuugauguc

SEQ ID NO: 543829 - RNA, 32 nt, Human
uuuaacuuucaucucuagggauguuuaacauu

SEQ ID NO: 543830 - RNA, 32 nt, Human
uuuaacuuucucugucucucuuccucagcaga

SEQ ID NO: 543831 - RNA, 23 nt, Human
uuuaagaaaacaucuuuauauua

SEQ ID NO: 543832 - RNA, 32 nt, Human
uuuaagaaaaugugggaauaccaaauguccuu

SEQ ID NO: 543833 - RNA, 32 nt, Human
uuuaagaaaccaguagcuagcugcuauuuaua

SEQ ID NO: 543834 - RNA, 32 nt, Human
uuuaagaaagagaaugaacuguggaauuuauu

SEQ ID NO: 543835 - RNA, 32 nt, Human
uuuaagaaauacaggugcaugaccaauuguca

SEQ ID NO: 543836 - RNA, 23 nt, Human
uuuaagaaaugccaauuauguca

SEQ ID NO: 543837 - RNA, 32 nt, Human
uuuaagaaccucucaaaacgaaacaagcaaau

SEQ ID NO: 543838 - RNA, 32 nt, Human
uuuaagaacugauguagaaugagggaggggaa

SEQ ID NO: 543839 - RNA, 32 nt, Human
uuuaagaagcauccucugccaagaccaaaagg

SEQ ID NO: 543840 - RNA, 21 nt, Human
uuuaagaauauaauuauguca

SEQ ID NO: 543841 - RNA, 32 nt, Human
uuuaagaaucuauuuccuuuccagucauuuca

SEQ ID NO: 543842 - RNA, 32 nt, Human
uuuaagaaugugccauggaaagugauaagaaa

SEQ ID NO: 543843 - RNA, 32 nt, Human
uuuaagacaaauucuguuaaucaacaagggcu

SEQ ID NO: 543844 - RNA, 32 nt, Human
uuuaagaccagccugaccaacauggagaaacc

SEQ ID NO: 543845 - RNA, 32 nt, Human
uuuaagaccagccugaccaacauggugaaacc

SEQ ID NO: 543846 - RNA, 24 nt, Human
uuuaagaccagccugagcaacaua

SEQ ID NO: 543847 - RNA, 24 nt, Human
uuuaagaccagccuggacaacaua

SEQ ID NO: 543848 - RNA, 32 nt, Human
uuuaagaccagccuggacaacauaggaagauc

SEQ ID NO: 543849 - RNA, 24 nt, Human
uuuaagaccagccuggccaacaug

SEQ ID NO: 543850 - RNA, 32 nt, Human
uuuaagaccagccuggccaacauggcaaaacc

SEQ ID NO: 543851 - RNA, 32 nt, Human
uuuaagaccagccuggccaacuuggugaaacc

SEQ ID NO: 543852 - RNA, 32 nt, Human
uuuaagaccagccugggcaacaaagugagacc

SEQ ID NO: 543853 - RNA, 32 nt, Human
uuuaagaccagccugggcaacacaggaugacc

SEQ ID NO: 543854 - RNA, 23 nt, Human
uuuaagaccagccugggcaacau

SEQ ID NO: 543855 - RNA, 24 nt, Human
uuuaagaccagccugggcaacaua

SEQ ID NO: 543856 - RNA, 32 nt, Human
uuuaagaccagccugggcaacauacagaaagc

SEQ ID NO: 543857 - RNA, 32 nt, Human
uuuaagaccagccugggcaacauagcaagacc

SEQ ID NO: 543858 - RNA, 24 nt, Human
uuuaagaccagccugggcaacaug

SEQ ID NO: 543859 - RNA, 32 nt, Human
uuuaagaccagccugggcaacauggugaagcc

SEQ ID NO: 543860 - RNA, 32 nt, Human
uuuaagaccagccugggcaacauugggagacu

SEQ ID NO: 543861 - RNA, 32 nt, Human
uuuaagaccagccugggcaagauagcaagacc

SEQ ID NO: 543862 - RNA, 32 nt, Human
uuuaagaccagcuugaccaacauggugaaacc

SEQ ID NO: 543863 - RNA, 32 nt, Human
uuuaagacccuaucacuccacagggaacuggu

SEQ ID NO: 543864 - RNA, 32 nt, Human
uuuaagaccugccugggcaacauagugagacc

SEQ ID NO: 543865 - RNA, 32 nt, Human
uuuaagaccuggccuggaauaaauacguuuug

SEQ ID NO: 543866 - RNA, 24 nt, Human
uuuaagacuagccuggccaacaug

SEQ ID NO: 543867 - RNA, 32 nt, Human
uuuaagacuagccuggccaacauggugaaacc

SEQ ID NO: 543868 - RNA, 21 nt, Human
uuuaagacuagccugggcgac

SEQ ID NO: 543869 - RNA, 32 nt, Human
uuuaagacuccagccaccccucuugggcucuc

SEQ ID NO: 543870 - RNA, 32 nt, Human
uuuaagacugaaagaaggagaauuucuaaccu

SEQ ID NO: 543871 - RNA, 32 nt, Human
uuuaagagaacuccaggacacaauucagcccg

SEQ ID NO: 543872 - RNA, 32 nt, Human
uuuaagagagggcugauuaucacagcccucuu

SEQ ID NO: 543873 - RNA, 32 nt, Human
uuuaagagauauuagagcaaguauuuaauuca

SEQ ID NO: 543874 - RNA, 32 nt, Human
uuuaagagaugagggagagagagccagagaca

SEQ ID NO: 543875 - RNA, 32 nt, Human
uuuaagagauggagucucucacucuguggccc

SEQ ID NO: 543876 - RNA, 32 nt, Human
uuuaagagauggggucucacuauguugcccag

SEQ ID NO: 543877 - RNA, 32 nt, Human
uuuaagagauuaaagugccagauggaguuuaa

SEQ ID NO: 543878 - RNA, 24 nt, Human
uuuaagagccacaaaauuguauca

SEQ ID NO: 543879 - RNA, 31 nt, Human
uuuaagaggaaauggacuggcauuuauggug

SEQ ID NO: 543880 - RNA, 32 nt, Human
uuuaagagggagagaggggaggcaaagcugaa

SEQ ID NO: 543881 - RNA, 32 nt, Human
uuuaagaggugcagccucuggaaguggaucaa

SEQ ID NO: 543882 - RNA, 32 nt, Human
uuuaagaucagccuggccaacauaaggagacc

SEQ ID NO: 543883 - RNA, 24 nt, Human
uuuaagaucagucugggcaauaug

SEQ ID NO: 543884 - RNA, 32 nt, Human
uuuaagauuauacaagugaagcauuaaaagag

SEQ ID NO: 543885 - RNA, 32 nt, Human
uuuaagcaaccagaauuccacacuguaggaag

SEQ ID NO: 543886 - RNA, 32 nt, Human
uuuaagcaaccuuugaauccagcucuagucag

SEQ ID NO: 543887 - RNA, 32 nt, Human
uuuaagcagcuuguaauuuauugaucuacaug

SEQ ID NO: 543888 - RNA, 32 nt, Human
uuuaagcaguuauuaccucagcauuuugacau

SEQ ID NO: 543889 - RNA, 32 nt, Human
uuuaagcaugaaugcguucuggaacacguuag

SEQ ID NO: 543890 - RNA, 32 nt, Human
uuuaagcaugcaccacaaucuccugcaagccu

SEQ ID NO: 543891 - RNA, 32 nt, Human
uuuaagcauguucaguggcagcuccccuccag

SEQ ID NO: 543892 - RNA, 32 nt, Human
uuuaagccacguaggaacuuucuugagggaua

SEQ ID NO: 543893 - RNA, 32 nt, Human
uuuaagccagggcuggagggcaaaggucauaa

SEQ ID NO: 543894 - RNA, 32 nt, Human
uuuaagccaguauuuguuccuguuuuacaaug

SEQ ID NO: 543895 - RNA, 32 nt, Human
uuuaagccaguuucagauuuacucugaaaugu

SEQ ID NO: 543896 - RNA, 32 nt, Human
uuuaagccaucguuccccuccugaacgguugc

SEQ ID NO: 543897 - RNA, 32 nt, Human
uuuaagccccugcaccuggaacuguguauuuu

SEQ ID NO: 543898 - RNA, 32 nt, Human
uuuaagccucauucuccuuuuguucauuuugg

SEQ ID NO: 543899 - RNA, 32 nt, Human
uuuaagccuuucuucugccaaggucaccagca

SEQ ID NO: 543900 - RNA, 19 nt, Human
uuuaagcuacuucugcagu

SEQ ID NO: 543901 - RNA, 32 nt, Human
uuuaagcuauauccccuugucauuccauugag

SEQ ID NO: 543902 - RNA, 32 nt, Human
uuuaagcugcugcugcauacacauuucacuuu

SEQ ID NO: 543903 - RNA, 32 nt, Human
uuuaagcugucugacauugaccuccuuucauu

SEQ ID NO: 543904 - RNA, 32 nt, Human
uuuaagcuguucugcagauugggguguuauua

SEQ ID NO: 543905 - RNA, 32 nt, Human
uuuaagcuucuaaaaugucaucuaucaagcac

SEQ ID NO: 543906 - RNA, 32 nt, Human
uuuaaggaaacuuuuuaauugugcaaaggaua

SEQ ID NO: 543907 - RNA, 32 nt, Human
uuuaaggaaaguuggagguguuuuaggauugc

SEQ ID NO: 543908 - RNA, 32 nt, Human
uuuaaggagcaaaucacuucugucacaguuau

SEQ ID NO: 543909 - RNA, 32 nt, Human
uuuaaggagugagagagauguguacauaucuu

SEQ ID NO: 543910 - RNA, 32 nt, Human
uuuaaggaguugguaaaaagcaguucaacucu

SEQ ID NO: 543911 - RNA, 32 nt, Human
uuuaaggcacauccuagauggagggaguggag

SEQ ID NO: 543912 - RNA, 32 nt, Human
uuuaaggcaguacuguuuagcacuuugauauu

SEQ ID NO: 543913 - RNA, 32 nt, Human
uuuaaggccagccugggcaacauagcaaaacc

SEQ ID NO: 543914 - RNA, 32 nt, Human
uuuaaggccggaguucaugaccagccugggca

SEQ ID NO: 543915 - RNA, 32 nt, Human
uuuaaggccucauuuuucuucucccaugugga

SEQ ID NO: 543916 - RNA, 32 nt, Human
uuuaaggccuucagaaguaaauaaaguagcag

SEQ ID NO: 543917 - RNA, 22 nt, Human
uuuaaggcuagccugggcaaca

SEQ ID NO: 543918 - RNA, 32 nt, Human
uuuaaggcugagugugguggcucaugccugua

SEQ ID NO: 543919 - RNA, 32 nt, Human
uuuaagggccaggaaaggaagcauucagggaa

SEQ ID NO: 543920 - RNA, 32 nt, Human
uuuaaggguaagaguggaaaacagauaguccc

SEQ ID NO: 543921 - RNA, 32 nt, Human
uuuaagggugcugacauaaaguauuacaaaaa

SEQ ID NO: 543922 - RNA, 32 nt, Human
uuuaaggguuccagcaucccagagccaaaaac

SEQ ID NO: 543923 - RNA, 32 nt, Human
uuuaaggugaucucauugaugguaguucucag

SEQ ID NO: 543924 - RNA, 32 nt, Human
uuuaaggugucuaguaagacagcagcaguauu

SEQ ID NO: 543925 - RNA, 32 nt, Human
uuuaagguuaucucccuuguucccugaacauc

SEQ ID NO: 543926 - RNA, 32 nt, Human
uuuaagguuggugucuuacucccuggaagccu

SEQ ID NO: 543927 - RNA, 32 nt, Human
uuuaagguuguuuuccccuaaaaggaccuuua

SEQ ID NO: 543928 - RNA, 32 nt, Human
uuuaaguaauaugccaaaucauggcagcaaaa

SEQ ID NO: 543929 - RNA, 32 nt, Human
uuuaaguaccugccccuucaccucucagacga

SEQ ID NO: 543930 - RNA, 32 nt, Human
uuuaaguacuaaauugggcagggcuuuuuagu

SEQ ID NO: 543931 - RNA, 32 nt, Human
uuuaaguagagacaaggucucacuacauugcc

SEQ ID NO: 543932 - RNA, 32 nt, Human
uuuaaguauugcuuuuuguucaggugacaaau

SEQ ID NO: 543933 - RNA, 32 nt, Human
uuuaagucagaaccuuaaacauguggauauuu

SEQ ID NO: 543934 - RNA, 32 nt, Human
uuuaagucaggguuaccccaucaggaggacau

SEQ ID NO: 543935 - RNA, 32 nt, Human
uuuaagucauuuucaccuuuaagcuucaguua

SEQ ID NO: 543936 - RNA, 32 nt, Human
uuuaaguccugcucuauuuuccugggcagguu

SEQ ID NO: 543937 - RNA, 32 nt, Human
uuuaagucuuccagucuuccaugugaacuuua

SEQ ID NO: 543938 - RNA, 32 nt, Human
uuuaagugacugugguuuaaagcacaaaugcc

SEQ ID NO: 543939 - RNA, 32 nt, Human
uuuaagugccauucgagaggaguuggaacugc

SEQ ID NO: 543940 - RNA, 22 nt, Human
uuuaagugcugcuucugucagu

SEQ ID NO: 543941 - RNA, 32 nt, Human
uuuaagugcuuuucuucuugcccacaaacuag

SEQ ID NO: 543942 - RNA, 32 nt, Human
uuuaaguggcuuucagcaaaccucagucauau

SEQ ID NO: 543943 - RNA, 32 nt, Human
uuuaagugggagaagggugggcaguuaucacu

SEQ ID NO: 543944 - RNA, 32 nt, Human
uuuaaguggggugggaaggggagcacaauuuc

SEQ ID NO: 543945 - RNA, 32 nt, Human
uuuaagugguagggcucacagacugugugaag

SEQ ID NO: 543946 - RNA, 32 nt, Human
uuuaaguggugagggagauggaagcugcaccc

SEQ ID NO: 543947 - RNA, 32 nt, Human
uuuaaguguguauguaaguguggguaugugug

SEQ ID NO: 543948 - RNA, 32 nt, Human
uuuaaguucaaaugaaugaaacaacuauuuuu

SEQ ID NO: 543949 - RNA, 32 nt, Human
uuuaaguuccacugcuguuccucuuaccuuga

SEQ ID NO: 543950 - RNA, 32 nt, Human
uuuaauaaaagcuuuuaauugagaaccuacua

SEQ ID NO: 543951 - RNA, 32 nt, Human
uuuaauaacaauauauagaauuguagacugau

SEQ ID NO: 543952 - RNA, 32 nt, Human
uuuaauaacagcuuaaaacacacaucguacag

SEQ ID NO: 543953 - RNA, 32 nt, Human
uuuaauaaguaggagagaagggaggauuuauu

SEQ ID NO: 543954 - RNA, 22 nt, Human
uuuaauacacuuguaacuugga

SEQ ID NO: 543955 - RNA, 32 nt, Human
uuuaauacaggacuuuuaaauggcaguauuuc

SEQ ID NO: 543956 - RNA, 32 nt, Human
uuuaauacaguauuuauuauaaacauuuagac

SEQ ID NO: 543957 - RNA, 32 nt, Human
uuuaauacaguguggcuggaacugaguauuuu

SEQ ID NO: 543958 - RNA, 32 nt, Human
uuuaauacccagagagaggagaucuuccaggu

SEQ ID NO: 543959 - RNA, 32 nt, Human
uuuaauacucagcaagacaaguuucucaaugc

SEQ ID NO: 543960 - RNA, 32 nt, Human
uuuaauacugaacuuuggccuacuuugugaua

SEQ ID NO: 543961 - RNA, 32 nt, Human
uuuaauacugcaacugcucccuuuugcccagu

SEQ ID NO: 543962 - RNA, 32 nt, Human
uuuaauagagaugguuucacuauguuggccag

SEQ ID NO: 543963 - RNA, 32 nt, Human
uuuaauagcaagacaaacauguauuaugaugg

SEQ ID NO: 543964 - RNA, 32 nt, Human
uuuaauaggaguacaauaaaacuguugucagc

SEQ ID NO: 543965 - RNA, 32 nt, Human
uuuaauaguugauggggugggggugaggucau

SEQ ID NO: 543966 - RNA, 31 nt, Human
uuuaauaguuuauuuucccucuugcuucuuc

SEQ ID NO: 543967 - RNA, 32 nt, Human
uuuaauauagcacucaucuuucaagagagggc

SEQ ID NO: 543968 - RNA, 32 nt, Human
uuuaauaucacacccaugcccuuugucagguu

SEQ ID NO: 543969 - RNA, 32 nt, Human
uuuaauaucuuaagacuuccccucaacaugcu

SEQ ID NO: 543970 - RNA, 32 nt, Human
uuuaauaugcacugucuugucuucccacgcaa

SEQ ID NO: 543971 - RNA, 32 nt, Human
uuuaauauucuugagcacuugaaaauacuuuu

SEQ ID NO: 543972 - RNA, 32 nt, Human
uuuaauauuguacaguauagaaaccuccgauu

SEQ ID NO: 543973 - RNA, 32 nt, Human
uuuaauauuuucuucuuuagcauagcacuguc

SEQ ID NO: 543974 - RNA, 32 nt, Human
uuuaaucaaacucuggucucacugccuuaucu

SEQ ID NO: 543975 - RNA, 32 nt, Human
uuuaaucaagagccgaaauuauuacccuucuc

SEQ ID NO: 543976 - RNA, 32 nt, Human
uuuaaucacagaauauuccuguucccacagaa

SEQ ID NO: 543977 - RNA, 32 nt, Human
uuuaaucaccuguuuacuugucuccauucuua

SEQ ID NO: 543978 - RNA, 32 nt, Human
uuuaaucagauaagugaguaaagcuuuuauuu

SEQ ID NO: 543979 - RNA, 25 nt, Human
uuuaaucagguguggcuaucugaga

SEQ ID NO: 543980 - RNA, 32 nt, Human
uuuaaucagguguggcuaucugagaaaucaac

SEQ ID NO: 543981 - RNA, 32 nt, Human
uuuaaucaguguagcuaugugcugcugcugcu

SEQ ID NO: 543982 - RNA, 32 nt, Human
uuuaaucaugaagagaaaauuaguagcauuuc

SEQ ID NO: 543983 - RNA, 32 nt, Human
uuuaaucaugccacauuguauacaugaucaaa

SEQ ID NO: 543984 - RNA, 32 nt, Human
uuuaaucaugcuguuuaaacuguuguggcaca

SEQ ID NO: 543985 - RNA, 32 nt, Human
uuuaauccacugcaaggcaccuagagagacug

SEQ ID NO: 543986 - RNA, 32 nt, Human
uuuaauccacugcauccaucuaggauuuauuu

SEQ ID NO: 543987 - RNA, 32 nt, Human
uuuaauccacuuccuuucuucuucuucuaaaa

SEQ ID NO: 543988 - RNA, 32 nt, Human
uuuaauccaugcccuccucucucccucccugc

SEQ ID NO: 543989 - RNA, 32 nt, Human
uuuaaucccacuauggacucagucuccuggaa

SEQ ID NO: 543990 - RNA, 32 nt, Human
uuuaauccgcugucugggugcauguccacagu

SEQ ID NO: 543991 - RNA, 32 nt, Human
uuuaauccucuauuuugcucuuccuuguccau

SEQ ID NO: 543992 - RNA, 32 nt, Human
uuuaaucgaagaugauuaaagcauucaguccu

SEQ ID NO: 543993 - RNA, 32 nt, Human
uuuaaucuaauaugucaugaucuuuaaccuaa

SEQ ID NO: 543994 - RNA, 32 nt, Human
uuuaaucuagcacauuuguguagcccuaauca

SEQ ID NO: 543995 - RNA, 32 nt, Human
uuuaaucucauggggaugagcucagagaagcu

SEQ ID NO: 543996 - RNA, 32 nt, Human
uuuaaucugugaaaauggagagcuggcuucag

SEQ ID NO: 543997 - RNA, 32 nt, Human
uuuaaugaaaagcagcccccaaaaucauuuuc

SEQ ID NO: 543998 - RNA, 32 nt, Human
uuuaaugacuccacuggcugagcuucugguag

SEQ ID NO: 543999 - RNA, 32 nt, Human
uuuaaugagaugauuuucuucaucucauaauu

SEQ ID NO: 544000 - RNA, 23 nt, Human
uuuaaugauggugaagaaauaau

SEQ ID NO: 544001 - RNA, 32 nt, Human
uuuaaugcacacauucacacagugguaacaga

SEQ ID NO: 544002 - RNA, 32 nt, Human
uuuaaugcuagucaguaugcaccaccacagga

SEQ ID NO: 544003 - RNA, 32 nt, Human
uuuaaugcuaguuuccaccaucuuucaaugau

SEQ ID NO: 544004 - RNA, 32 nt, Human
uuuaaugcuguggcaugggugaagaggagggg

SEQ ID NO: 544005 - RNA, 32 nt, Human
uuuaaugcuugcaaucugagcucuugaacaaa

SEQ ID NO: 544006 - RNA, 32 nt, Human
uuuaauggauccagagagccaaggucagaggg

SEQ ID NO: 544007 - RNA, 32 nt, Human
uuuaauggcaccugggugauucuucagcuaaa

SEQ ID NO: 544008 - RNA, 32 nt, Human
uuuaauggcagcagaaaacuugugugaaauuu

SEQ ID NO: 544009 - RNA, 32 nt, Human
uuuaaugggauugaaagcacuuuuaccacaug

SEQ ID NO: 544010 - RNA, 32 nt, Human
uuuaaugggcagguucuugcucucccaggcug

SEQ ID NO: 544011 - RNA, 32 nt, Human
uuuaaugggguuucacccaaauuguuuaaugc

SEQ ID NO: 544012 - RNA, 32 nt, Human
uuuaaugguuaagaacugugaaauuuacaaau

SEQ ID NO: 544013 - RNA, 32 nt, Human
uuuaauguaguuguuaaagguaugaauucaug

SEQ ID NO: 544014 - RNA, 32 nt, Human
uuuaauguauuuagaguuccucauguugcagg

SEQ ID NO: 544015 - RNA, 32 nt, Human
uuuaauguccuuuagaagugggagucuggugg

SEQ ID NO: 544016 - RNA, 32 nt, Human
uuuaaugucucauuccccuugaggccagcugc

SEQ ID NO: 544017 - RNA, 32 nt, Human
uuuaauguuaggcagaacacauucauucagac

SEQ ID NO: 544018 - RNA, 32 nt, Human
uuuaauguuaggucccuucuccagucuuuucc

SEQ ID NO: 544019 - RNA, 32 nt, Human
uuuaauguucugauacauuaggaugaaguuaa

SEQ ID NO: 544020 - RNA, 32 nt, Human
uuuaauuaauuaaguaucugggauuauucuuu

SEQ ID NO: 544021 - RNA, 32 nt, Human
uuuaauuagaaaacauuucuucucucuuugug

SEQ ID NO: 544022 - RNA, 32 nt, Human
uuuaauuauagagagcaaaaguauugaaagua

SEQ ID NO: 544023 - RNA, 32 nt, Human
uuuaauuauauuaugaauaaaauuguuauuuc

SEQ ID NO: 544024 - RNA, 32 nt, Human
uuuaauuauccucacauauacuccuccggcuu

SEQ ID NO: 544025 - RNA, 32 nt, Human
uuuaauucaaugauuaaauaaacagaugaccu

SEQ ID NO: 544026 - RNA, 32 nt, Human
uuuaauucacccauaugcuuucaaaucuagua

SEQ ID NO: 544027 - RNA, 32 nt, Human
uuuaauucacuacaaaaugugcuuguuauuga

SEQ ID NO: 544028 - RNA, 32 nt, Human
uuuaauuccaauaaaauuuucuucauuuuugu

SEQ ID NO: 544029 - RNA, 32 nt, Human
uuuaauuccagaguacuguccucuacucuaag

SEQ ID NO: 544030 - RNA, 32 nt, Human
uuuaauuccuccucugccaggguggguccugg

SEQ ID NO: 544031 - RNA, 32 nt, Human
uuuaauucugcuuccccuagggugauauuucc

SEQ ID NO: 544032 - RNA, 32 nt, Human
uuuaauucuucaaauagucauaugaaaacaua

SEQ ID NO: 544033 - RNA, 32 nt, Human
uuuaauucuucacgguaagaaaaugaaguucu

SEQ ID NO: 544034 - RNA, 32 nt, Human
uuuaauucuugcuuauacucagucuauucggu

SEQ ID NO: 544035 - RNA, 32 nt, Human
uuuaauugaauaagcugcaugugugcauacuu

SEQ ID NO: 544036 - RNA, 32 nt, Human
uuuaauuggccuugguccucacagcuccaaaa

SEQ ID NO: 544037 - RNA, 32 nt, Human
uuuaauuggcuggcuguaauuugcauugagag

SEQ ID NO: 544038 - RNA, 32 nt, Human
uuuaauuggcuuugugccuccugcuuuacaac

SEQ ID NO: 544039 - RNA, 32 nt, Human
uuuaauugucagccucuggcugugcauuggug

SEQ ID NO: 544040 - RNA, 32 nt, Human
uuuaauugucuggcuucucucuggacugggag

SEQ ID NO: 544041 - RNA, 32 nt, Human
uuuaauugugauuuuaucaccuuucccauuuc

SEQ ID NO: 544042 - RNA, 32 nt, Human
uuuaauuucacaaacaucaggcaauuuccagg

SEQ ID NO: 544043 - RNA, 32 nt, Human
uuuaauuucaguauguaagaacaaauauuuug

SEQ ID NO: 544044 - RNA, 32 nt, Human
uuuaauuucuguaauugggaaggaggguaaua

SEQ ID NO: 544045 - RNA, 32 nt, Human
uuuaauuucuucuucuuuuccuuuuggcaaag

SEQ ID NO: 544046 - RNA, 32 nt, Human
uuuaauuucuuuguaaaaaccucaaaagugag

SEQ ID NO: 544047 - RNA, 32 nt, Human
uuuaauuugcagccuuagcucuguggugucug

SEQ ID NO: 544048 - RNA, 32 nt, Human
uuuaauuugccucgggaaucgcugcuuccaga

SEQ ID NO: 544049 - RNA, 32 nt, Human
uuuaauuugguugaacauuugcugcuaauggg

SEQ ID NO: 544050 - RNA, 32 nt, Human
uuuaauuuuaauucuuaaaauuuccaugacua

SEQ ID NO: 544051 - RNA, 32 nt, Human
uuuaauuuuagccauucuucugccucauuucu

SEQ ID NO: 544052 - RNA, 32 nt, Human
uuuaauuuuauguaugaguauguauguuccug

SEQ ID NO: 544053 - RNA, 32 nt, Human
uuuaauuuucacaggcucaucugggagaagga

SEQ ID NO: 544054 - RNA, 32 nt, Human
uuuaauuuucaucauuccauggagauucaguc

SEQ ID NO: 544055 - RNA, 32 nt, Human
uuuaauuuuccaggaaauuguacagcauaaaa

SEQ ID NO: 544056 - RNA, 32 nt, Human
uuuaauuuugucagauucacacaugccacuau

SEQ ID NO: 544057 - RNA, 32 nt, Human
uuuaauuuuuaagaguguucaauccgagauga

SEQ ID NO: 544058 - RNA, 32 nt, Human
uuuaauuuuugcaaagaaaaguuugaagucaa

SEQ ID NO: 544059 - RNA, 32 nt, Human
uuuacaaaaacaggcggcaggcugggguuggu

SEQ ID NO: 544060 - RNA, 32 nt, Human
uuuacaaaaaggcaauaaggugguuuaugguu

SEQ ID NO: 544061 - RNA, 32 nt, Human
uuuacaaaaauggauacaauagaaauguaaaa

SEQ ID NO: 544062 - RNA, 32 nt, Human
uuuacaaagagguuuuaugaaaagaauaaaaa

SEQ ID NO: 544063 - RNA, 32 nt, Human
uuuacaaaggggaaugguucuccagugcagcc

SEQ ID NO: 544064 - RNA, 32 nt, Human
uuuacaaaguaguuuauucuuauuauacuuuc

SEQ ID NO: 544065 - RNA, 32 nt, Human
uuuacaaaguguucucagucugaacaggaacc

SEQ ID NO: 544066 - RNA, 32 nt, Human
uuuacaaauguucuguuuuggcugcuauuggu

SEQ ID NO: 544067 - RNA, 32 nt, Human
uuuacaacauugcuucuacauucuuacugguu

SEQ ID NO: 544068 - RNA, 32 nt, Human
uuuacaaccacugcacuaccugacucaggaau

SEQ ID NO: 544069 - RNA, 32 nt, Human
uuuacaacgagaugcugcucuccauagggaug

SEQ ID NO: 544070 - RNA, 31 nt, Human
uuuacaacuuauuuccaacauuuaaacucug

SEQ ID NO: 544071 - RNA, 32 nt, Human
uuuacaagaaaaucucugucucuucaacaaug

SEQ ID NO: 544072 - RNA, 32 nt, Human
uuuacaagacuuguuaaagaugucagagugcc

SEQ ID NO: 544073 - RNA, 32 nt, Human
uuuacaagagcuuuccucuccucucucuugcu

SEQ ID NO: 544074 - RNA, 32 nt, Human
uuuacaagcagagacucacuccaacccaaacu

SEQ ID NO: 544075 - RNA, 32 nt, Human
uuuacaaggaagcagacacaggccuaggagua

SEQ ID NO: 544076 - RNA, 32 nt, Human
uuuacaaguagaaauuauuccuuucagaguaa

SEQ ID NO: 544077 - RNA, 32 nt, Human
uuuacaaguuaggaagcagaggaucagagaug

SEQ ID NO: 544078 - RNA, 32 nt, Human
uuuacaauauagaugacauuuuaaaaauguaa

SEQ ID NO: 544079 - RNA, 32 nt, Human
uuuacacaaaccugaaaagauguugugucuug

SEQ ID NO: 544080 - RNA, 32 nt, Human
uuuacacaaauguaagaaauucuaccaaggag

SEQ ID NO: 544081 - RNA, 32 nt, Human
uuuacacaccacugcauuaacuagaacugcug

SEQ ID NO: 544082 - RNA, 32 nt, Human
uuuacacaccucgccucguucucucugcuggu

SEQ ID NO: 544083 - RNA, 32 nt, Human
uuuacacacuacacguauaaauauuguaacug

SEQ ID NO: 544084 - RNA, 32 nt, Human
uuuacacacuccuuucacuguagcuugacuaa

SEQ ID NO: 544085 - RNA, 32 nt, Human
uuuacacaguauaucacauuuuauccuuaaac

SEQ ID NO: 544086 - RNA, 32 nt, Human
uuuacacagugcuuuccagccuuuggugcuua

SEQ ID NO: 544087 - RNA, 32 nt, Human
uuuacacauaaauaguuauaucaaugucagcc

SEQ ID NO: 544088 - RNA, 32 nt, Human
uuuacaccacuaucuccguuccaucugggcuu

SEQ ID NO: 544089 - RNA, 32 nt, Human
uuuacaccacugcacuccagucuggaugacaa

SEQ ID NO: 544090 - RNA, 22 nt, Human
uuuacacccuguaauuuauuca

SEQ ID NO: 544091 - RNA, 32 nt, Human
uuuacacccuugauucuucuugaagcaucacu

SEQ ID NO: 544092 - RNA, 32 nt, Human
uuuacaccuaguuucuaauaagcauuuuauaa

SEQ ID NO: 544093 - RNA, 32 nt, Human
uuuacaccuguaaucccagcacuuugggaggc

SEQ ID NO: 544094 - RNA, 32 nt, Human
uuuacacuggccacagaugucaggauuaagaa

SEQ ID NO: 544095 - RNA, 32 nt, Human
uuuacacuguaacuuacuccugaaggaaggag

SEQ ID NO: 544096 - RNA, 32 nt, Human
uuuacacuucucucaacuaaaacaucugguua

SEQ ID NO: 544097 - RNA, 32 nt, Human
uuuacacuuguacaauuauguaguaaauguau

SEQ ID NO: 544098 - RNA, 32 nt, Human
uuuacagaaagccacagaggugcaacuugagg

SEQ ID NO: 544099 - RNA, 32 nt, Human
uuuacagagaaaaggcuugguggugggauuuu

SEQ ID NO: 544100 - RNA, 32 nt, Human
uuuacagagacacugcacagcuuacacuccug

SEQ ID NO: 544101 - RNA, 32 nt, Human
uuuacagagagaagaauugaaggcgggaaugc

SEQ ID NO: 544102 - RNA, 32 nt, Human
uuuacagagagaggaauuuaaaagaggacauc

SEQ ID NO: 544103 - RNA, 32 nt, Human
uuuacagagagggaaggagagcagaauauuuc

SEQ ID NO: 544104 - RNA, 32 nt, Human
uuuacagagggagcugucuccagacagcucca

SEQ ID NO: 544105 - RNA, 32 nt, Human
uuuacagaguaccugcucgggccagguaaaug

SEQ ID NO: 544106 - RNA, 32 nt, Human
uuuacagagucacagaucugucagccugggaa

SEQ ID NO: 544107 - RNA, 32 nt, Human
uuuacagauaucaaagcucagcucuuugaaac

SEQ ID NO: 544108 - RNA, 32 nt, Human
uuuacagaugcaugccaccacgcccagcuaau

SEQ ID NO: 544109 - RNA, 32 nt, Human
uuuacagauuauuaaauaaagcugcauauguc

SEQ ID NO: 544110 - RNA, 32 nt, Human
uuuacagcaauauguuuccacucucuuccuug

SEQ ID NO: 544111 - RNA, 32 nt, Human
uuuacagcauacaagcuucugcuccaguauga

SEQ ID NO: 544112 - RNA, 32 nt, Human
uuuacagccauuucuguucacacuuuucaccc

SEQ ID NO: 544113 - RNA, 32 nt, Human
uuuacagcccugcuacuuuugcuuuugaaucu

SEQ ID NO: 544114 - RNA, 32 nt, Human
uuuacagcuaugucuagguucuccgcucaggg

SEQ ID NO: 544115 - RNA, 32 nt, Human
uuuacagcucuccuccagcccugggcacauag

SEQ ID NO: 544116 - RNA, 32 nt, Human
uuuacagcucuggaacacuuuggggcugauuu

SEQ ID NO: 544117 - RNA, 32 nt, Human
uuuacagcuggaagggcagacggaggcaucuu

SEQ ID NO: 544118 - RNA, 32 nt, Human
uuuacagcuggagaucacuggaaaggugucuc

SEQ ID NO: 544119 - RNA, 32 nt, Human
uuuacagcuggccagugcagagcugcugcucu

SEQ ID NO: 544120 - RNA, 30 nt, Human
uuuacagcuucuguccugcuccugcaucuu

SEQ ID NO: 544121 - RNA, 23 nt, Human
uuuacagcuuuucuagagcagcu

SEQ ID NO: 544122 - RNA, 32 nt, Human
uuuacaggagaaagaggugauuauggagggaa

SEQ ID NO: 544123 - RNA, 32 nt, Human
uuuacaggagcagggaagagcaguagaggaug

SEQ ID NO: 544124 - RNA, 32 nt, Human
uuuacaggaggugagugugagucauuagagac

SEQ ID NO: 544125 - RNA, 32 nt, Human
uuuacaggcagaaugaguucaugugaaauuuc

SEQ ID NO: 544126 - RNA, 32 nt, Human
uuuacaggcaugagccaccacacccagcuccu

SEQ ID NO: 544127 - RNA, 32 nt, Human
uuuacaggcaugagccaccacgcccagccuuc

SEQ ID NO: 544128 - RNA, 32 nt, Human
uuuacaggcaugagccaccgcacccagccuac

SEQ ID NO: 544129 - RNA, 32 nt, Human
uuuacaggcaugagccaccgcgcccggccugu

SEQ ID NO: 544130 - RNA, 32 nt, Human
uuuacaggcggaaacuccucggcugcuuuuuc

SEQ ID NO: 544131 - RNA, 32 nt, Human
uuuacaggcgugagccaccgcgcccggccagu

SEQ ID NO: 544132 - RNA, 32 nt, Human
uuuacaggcgugagccaccgcgcccggccgaa

SEQ ID NO: 544133 - RNA, 32 nt, Human
uuuacaggcuugagccacgcguccggccugaa

SEQ ID NO: 544134 - RNA, 32 nt, Human
uuuacaggggagaaaaaugacaaaugacgucu

SEQ ID NO: 544135 - RNA, 22 nt, Human
uuuacaggucuucucuccaacu

SEQ ID NO: 544136 - RNA, 31 nt, Human
uuuacaggugagagauuugaagccuggggag

SEQ ID NO: 544137 - RNA, 32 nt, Human
uuuacaggugccugccagcacgcccagcuaau

SEQ ID NO: 544138 - RNA, 32 nt, Human
uuuacaggugugagccaccacaccaggccaga

SEQ ID NO: 544139 - RNA, 32 nt, Human
uuuacaggugugagccacugugcccagcucuc

SEQ ID NO: 544140 - RNA, 32 nt, Human
uuuacaggugugagccacugugccuaccagcu

SEQ ID NO: 544141 - RNA, 32 nt, Human
uuuacagguguuauuagcacaacugaagaacu

SEQ ID NO: 544142 - RNA, 22 nt, Human
uuuacagguucucuuaagcaau

SEQ ID NO: 544143 - RNA, 32 nt, Human
uuuacaguaggaaacgccaguaaacaacuuuu

SEQ ID NO: 544144 - RNA, 32 nt, Human
uuuacagugaggacucggccacugugucucug

SEQ ID NO: 544145 - RNA, 32 nt, Human
uuuacagugcagcauaaugccaugggcuuccg

SEQ ID NO: 544146 - RNA, 32 nt, Human
uuuacaguucaggccugcugugaaucuuugau

SEQ ID NO: 544147 - RNA, 32 nt, Human
uuuacaguucugcaguguaauggaggacgggc

SEQ ID NO: 544148 - RNA, 22 nt, Human
uuuacaguuugcuaaaucuuau

SEQ ID NO: 544149 - RNA, 32 nt, Human
uuuacaguuuugaauaaaagcauuuacaauuu

SEQ ID NO: 544150 - RNA, 32 nt, Human
uuuacaguuuugacaaaauacucuuauacacc

SEQ ID NO: 544151 - RNA, 24 nt, Human
uuuacauaauuaugaguuuguuca

SEQ ID NO: 544152 - RNA, 32 nt, Human
uuuacauacacauugcuucuaguuggcagaaa

SEQ ID NO: 544153 - RNA, 32 nt, Human
uuuacauacauuuucuccacuucuaauuguga

SEQ ID NO: 544154 - RNA, 32 nt, Human
uuuacauacguugucuagaaguaccauagggu

SEQ ID NO: 544155 - RNA, 32 nt, Human
uuuacauagcuaugaucguuguguacauucuc

SEQ ID NO: 544156 - RNA, 32 nt, Human
uuuacauaggaaauguacugugggaacuauuc

SEQ ID NO: 544157 - RNA, 32 nt, Human
uuuacauauaauaaauagaaauuuuguuaaca

SEQ ID NO: 544158 - RNA, 32 nt, Human
uuuacauauacccaguaucuuugcacaaacca

SEQ ID NO: 544159 - RNA, 32 nt, Human
uuuacaucauuucucauccucacaacaauccu

SEQ ID NO: 544160 - RNA, 32 nt, Human
uuuacauccugcugcugauagguucaaggaau

SEQ ID NO: 544161 - RNA, 32 nt, Human
uuuacauccuuucuaaugacaaugaauggaau

SEQ ID NO: 544162 - RNA, 32 nt, Human
uuuacaucuccaaaggccagucccaaacacgc

SEQ ID NO: 544163 - RNA, 32 nt, Human
uuuacaucucucauggcugggcagcagcugug

SEQ ID NO: 544164 - RNA, 32 nt, Human
uuuacaucucugcaggccucacaugccgugac

SEQ ID NO: 544165 - RNA, 32 nt, Human
uuuacaucuugcucuucccagcauuccuuagg

SEQ ID NO: 544166 - RNA, 23 nt, Human
uuuacaugaacuguguuuguuca

SEQ ID NO: 544167 - RNA, 32 nt, Human
uuuacaugaagcauccagaaaagagaaaugua

SEQ ID NO: 544168 - RNA, 32 nt, Human
uuuacaugaauacacacacauauucacuaaac

SEQ ID NO: 544169 - RNA, 32 nt, Human
uuuacaugcaacccucucuucuugccucucaa

SEQ ID NO: 544170 - RNA, 30 nt, Human
uuuacaugcaugcaaucagacaggccacua

SEQ ID NO: 544171 - RNA, 32 nt, Human
uuuacaugccagccaucucugcaauuaaaguu

SEQ ID NO: 544172 - RNA, 32 nt, Human
uuuacauggauccauugccccagcuacuggag

SEQ ID NO: 544173 - RNA, 32 nt, Human
uuuacauucuugcucugcucaucuacacauau

SEQ ID NO: 544174 - RNA, 32 nt, Human
uuuacauuggagggccaauggcugguccuuca

SEQ ID NO: 544175 - RNA, 32 nt, Human
uuuacauuuaggaaagugaggcaaacaccuug

SEQ ID NO: 544176 - RNA, 25 nt, Human
uuuacauuuuagggcacaguucuuu

SEQ ID NO: 544177 - RNA, 22 nt, Human
uuuacauuuuugacaguuuuuu

SEQ ID NO: 544178 - RNA, 32 nt, Human
uuuaccaaaaauacaaaaauuagccaggugua

SEQ ID NO: 544179 - RNA, 19 nt, Human
uuuaccaaaacaaaacaga

SEQ ID NO: 544180 - RNA, 32 nt, Human
uuuaccaaaauacauguguaguugucacuuca

SEQ ID NO: 544181 - RNA, 32 nt, Human
uuuaccaacauguaucugucuacuuucucuug

SEQ ID NO: 544182 - RNA, 32 nt, Human
uuuaccaagagagaugucuccgggcccuuauu

SEQ ID NO: 544183 - RNA, 32 nt, Human
uuuaccaagcagggacuuugggccagguccgu

SEQ ID NO: 544184 - RNA, 32 nt, Human
uuuaccaaguugcuggaacuacaggcacgcac

SEQ ID NO: 544185 - RNA, 32 nt, Human
uuuaccaauagaguugaccuguuauuggauuu

SEQ ID NO: 544186 - RNA, 32 nt, Human
uuuaccaaugagccuuaauuuuuauauagguc

SEQ ID NO: 544187 - RNA, 32 nt, Human
uuuaccacauaaauguuuuaaauaucagauuu

SEQ ID NO: 544188 - RNA, 32 nt, Human
uuuaccaccucaacaggaacauugacuuguuu

SEQ ID NO: 544189 - RNA, 32 nt, Human
uuuaccacucaggcucuauuugugccuuagcu

SEQ ID NO: 544190 - RNA, 32 nt, Human
uuuaccacugaaagaagaucuaugaaaaugug

SEQ ID NO: 544191 - RNA, 32 nt, Human
uuuaccacugagcucugggaaggaggccagga

SEQ ID NO: 544192 - RNA, 32 nt, Human
uuuaccacugcacuccagcuugggcgacggag

SEQ ID NO: 544193 - RNA, 32 nt, Human
uuuaccagcauccugcuccacugccuuccucu

SEQ ID NO: 544194 - RNA, 32 nt, Human
uuuaccagccucaguguggaggcuccauccca

SEQ ID NO: 544195 - RNA, 32 nt, Human
  misc_feature (29)..(29): n is a, c, g or u
uuuaccagcuucaaacuauguaaaggacnuuc

SEQ ID NO: 544196 - RNA, 32 nt, Human
uuuaccagcuuuuaaccaucugauaucuauag

SEQ ID NO: 544197 - RNA, 32 nt, Human
uuuaccaggaaggauggaaggggcuucagccu

SEQ ID NO: 544198 - RNA, 32 nt, Human
uuuaccaggagggcacauggaggaugcaagaa

SEQ ID NO: 544199 - RNA, 32 nt, Human
uuuaccaggggcagugccucucugcgggggag

SEQ ID NO: 544200 - RNA, 32 nt, Human
uuuaccagguaucugggcaucccuugguucac

SEQ ID NO: 544201 - RNA, 32 nt, Human
uuuaccagguccccuuccuacccuccaguccc

SEQ ID NO: 544202 - RNA, 32 nt, Human
uuuaccagucauuucuauuggaauuuguuuuu

SEQ ID NO: 544203 - RNA, 32 nt, Human
uuuaccagucugagugacagcuccccuuggcu

SEQ ID NO: 544204 - RNA, 32 nt, Human
uuuaccauauuucuaaacuuuguuuauaacuc

SEQ ID NO: 544205 - RNA, 32 nt, Human
uuuaccaucccgaagaaccaacuccuacaaau

SEQ ID NO: 544206 - RNA, 32 nt, Human
uuuaccaucccuccuucucuccuuccacagcu

SEQ ID NO: 544207 - RNA, 32 nt, Human
uuuaccaugccagauggacaccagcuucuuug

SEQ ID NO: 544208 - RNA, 32 nt, Human
uuuaccaugccccugacacugcacugagcacu

SEQ ID NO: 544209 - RNA, 32 nt, Human
uuuaccaugccuggaaauuuuacaggggaaga

SEQ ID NO: 544210 - RNA, 32 nt, Human
uuuaccauguaacuuaauguuugcaaggccag

SEQ ID NO: 544211 - RNA, 32 nt, Human
uuuaccaugugaguccugcaacacuaaagaua

SEQ ID NO: 544212 - RNA, 32 nt, Human
uuuaccauguggagggcaccaagcuauucaug

SEQ ID NO: 544213 - RNA, 32 nt, Human
uuuaccauucugaaaauuuuaaaacaagaauu

SEQ ID NO: 544214 - RNA, 32 nt, Human
uuuaccauucuuccacugugcuguuauaaagu

SEQ ID NO: 544215 - RNA, 32 nt, Human
uuuaccauugagagucaaugaaguugcuauuu

SEQ ID NO: 544216 - RNA, 32 nt, Human
uuuacccaaacaguaccccacacugcaagagg

SEQ ID NO: 544217 - RNA, 32 nt, Human
uuuacccaaauuugaacuagucuguuggguug

SEQ ID NO: 544218 - RNA, 32 nt, Human
uuuacccacuucucaguuuauaaugggggaaa

SEQ ID NO: 544219 - RNA, 32 nt, Human
uuuacccacuucucuguaucugccuuucucug

SEQ ID NO: 544220 - RNA, 32 nt, Human
uuuacccagcaaaccccagcugcuucagcagc

SEQ ID NO: 544221 - RNA, 23 nt, Human
uuuacccaggcuggagugcaaug

SEQ ID NO: 544222 - RNA, 32 nt, Human
uuuacccagugggucccuucgaugcugagggu

SEQ ID NO: 544223 - RNA, 32 nt, Human
uuuacccaguucauuucuuucuggcauuugua

SEQ ID NO: 544224 - RNA, 18 nt, Human
uuuacccuccaggacagc

SEQ ID NO: 544225 - RNA, 32 nt, Human
uuuacccucccaggccccaacggcagcacuua

SEQ ID NO: 544226 - RNA, 32 nt, Human
uuuacccugcucccucucucugucccuaggcu

SEQ ID NO: 544227 - RNA, 32 nt, Human
uuuacccuuaagaguauguuacauuugauuac

SEQ ID NO: 544228 - RNA, 32 nt, Human
uuuacccuuguuuucccuuguuauggcucuuc

SEQ ID NO: 544229 - RNA, 24 nt, Human
uuuacccuuuaccuaacagacuaa

SEQ ID NO: 544230 - RNA, 32 nt, Human
uuuaccuaaucaagccugggcaauggcgggcg

SEQ ID NO: 544231 - RNA, 32 nt, Human
uuuaccuaccccagucuuuggaacccuaaaua

SEQ ID NO: 544232 - RNA, 32 nt, Human
uuuaccuacugaggcucaagccuucacaguga

SEQ ID NO: 544233 - RNA, 32 nt, Human
uuuaccuagucuccuuagaaauggagucccca

SEQ ID NO: 544234 - RNA, 32 nt, Human
uuuaccuauggcaugagagagauggcuauggc

SEQ ID NO: 544235 - RNA, 30 nt, Human
uuuaccuauugcuguaagaaaugacgaucc

SEQ ID NO: 544236 - RNA, 32 nt, Human
uuuaccuccauaagaauagggaaaguagaaca

SEQ ID NO: 544237 - RNA, 32 nt, Human
uuuaccucccucacagagucacugugaggauu

SEQ ID NO: 544238 - RNA, 32 nt, Human
uuuaccuccuuuucucuuucacggggccguga

SEQ ID NO: 544239 - RNA, 31 nt, Human
uuuaccugccucucuuccuggaucgucucca

SEQ ID NO: 544240 - RNA, 32 nt, Human
uuuaccuggagcugagucaauuuagagagcug

SEQ ID NO: 544241 - RNA, 32 nt, Human
uuuaccuggguuugagccuacagucuauuuau

SEQ ID NO: 544242 - RNA, 32 nt, Human
uuuaccuguuaguuggaaguacccagaauuau

SEQ ID NO: 544243 - RNA, 32 nt, Human
uuuaccuuacucuguuuagaaaaguauacaag

SEQ ID NO: 544244 - RNA, 32 nt, Human
uuuaccuuacuuuuguugcaaucacuguuguu

SEQ ID NO: 544245 - RNA, 22 nt, Human
uuuaccuuauuaguguuaccaa

SEQ ID NO: 544246 - RNA, 32 nt, Human
uuuaccuuccuccaaauuacccaacauacggu

SEQ ID NO: 544247 - RNA, 32 nt, Human
uuuaccuuccuucccuuccugcucccagacag

SEQ ID NO: 544248 - RNA, 32 nt, Human
uuuaccuuccuucuccucuguauucuuacaga

SEQ ID NO: 544249 - RNA, 32 nt, Human
uuuaccuucucaucuucuuauuuuccaaauua

SEQ ID NO: 544250 - RNA, 32 nt, Human
uuuaccuuguugggugcuggauauuucuguau

SEQ ID NO: 544251 - RNA, 23 nt, Human
uuuaccuuuaccuauagccugga

SEQ ID NO: 544252 - RNA, 21 nt, Human
uuuaccuuuacuuggcuuaga

SEQ ID NO: 544253 - RNA, 23 nt, Human
uuuaccuuugcauaaguguuuga

SEQ ID NO: 544254 - RNA, 32 nt, Human
uuuaccuuuggggcugagccaagugcaucucu

SEQ ID NO: 544255 - RNA, 32 nt, Human
uuuaccuuuugaggaggaugagcgggaggugg

SEQ ID NO: 544256 - RNA, 32 nt, Human
uuuacgagguaucagcacuuuucuuucauuag

SEQ ID NO: 544257 - RNA, 32 nt, Human
uuuacgccuguaaucccagcacugugggaggc

SEQ ID NO: 544258 - RNA, 32 nt, Human
uuuacggaagggggaaacagaaaacagccucc

SEQ ID NO: 544259 - RNA, 32 nt, Human
uuuacggcaguguggcuggagccgcggcugac

SEQ ID NO: 544260 - RNA, 32 nt, Human
uuuacgggaucugcuaguggcuugccuacuua

SEQ ID NO: 544261 - RNA, 23 nt, Human
uuuacgggcacggugugguguca

SEQ ID NO: 544262 - RNA, 32 nt, Human
uuuacggucugucaguaaagaaaacaaaaacu

SEQ ID NO: 544263 - RNA, 32 nt, Human
uuuacgguuuuccagguuuaagcuguuacugu

SEQ ID NO: 544264 - RNA, 32 nt, Human
uuuacguaccaaugcuacucugcuguucacaa

SEQ ID NO: 544265 - RNA, 32 nt, Human
uuuacguacuggaggaaaguguguaaaaccau

SEQ ID NO: 544266 - RNA, 22 nt, Human
uuuacguauauuacaguucuuu

SEQ ID NO: 544267 - RNA, 32 nt, Human
uuuacgugugugaaaacugaagcacagaagaa

SEQ ID NO: 544268 - RNA, 32 nt, Human
uuuacguuacacuaaaaccacaugugcaacaa

SEQ ID NO: 544269 - RNA, 32 nt, Human
uuuacuaaaaacauuccagucuuggccgggug

SEQ ID NO: 544270 - RNA, 32 nt, Human
uuuacuaaaaauacaaaaauuagccaggcaug

SEQ ID NO: 544271 - RNA, 32 nt, Human
uuuacuaaaaauacaaaaauuagccaggcgca

SEQ ID NO: 544272 - RNA, 32 nt, Human
uuuacuaaaaauacaaaaauuagccaggcgug

SEQ ID NO: 544273 - RNA, 32 nt, Human
uuuacuaaaaauacaaaaauuagccgggcaug

SEQ ID NO: 544274 - RNA, 32 nt, Human
uuuacuaaaaauacaaaaauuagccgggcgug

SEQ ID NO: 544275 - RNA, 32 nt, Human
uuuacuaaaaauacaaaaauuagucaggcaug

SEQ ID NO: 544276 - RNA, 32 nt, Human
uuuacuaaaaauacaaaauuagccaggcaugg

SEQ ID NO: 544277 - RNA, 32 nt, Human
uuuacuaaaaauacaaaauuagccaggugugg

SEQ ID NO: 544278 - RNA, 32 nt, Human
uuuacuaaaccacacugaagcuauaguaccuu

SEQ ID NO: 544279 - RNA, 32 nt, Human
uuuacuaacauacucauucuucacaaaauucu

SEQ ID NO: 544280 - RNA, 32 nt, Human
uuuacuaagcuggcuggacucaugaucacuga

SEQ ID NO: 544281 - RNA, 32 nt, Human
uuuacuaaggagaugugcaaugcugaaguuag

SEQ ID NO: 544282 - RNA, 32 nt, Human
uuuacuacaaugaggugcauacccccagcgug

SEQ ID NO: 544283 - RNA, 32 nt, Human
uuuacuacacacacaguguuaacaaagcacug

SEQ ID NO: 544284 - RNA, 32 nt, Human
uuuacuaccaguuaaagagggagaacggagga

SEQ ID NO: 544285 - RNA, 32 nt, Human
uuuacuagacaggguuucaccauguuggcuag

SEQ ID NO: 544286 - RNA, 31 nt, Human
uuuacuagcgcaauacugcacuuguaaauga

SEQ ID NO: 544287 - RNA, 32 nt, Human
uuuacuagcuuuuucauugucuuuccaugaaa

SEQ ID NO: 544288 - RNA, 32 nt, Human
uuuacuauaaaacagaaagcaugugaaaacau

SEQ ID NO: 544289 - RNA, 32 nt, Human
uuuacuauagcuauuuuuaaaguuucucuacu

SEQ ID NO: 544290 - RNA, 32 nt, Human
uuuacuauauuuaaaugcauugguuaaguuua

SEQ ID NO: 544291 - RNA, 32 nt, Human
uuuacuauucucauguauuucauuucacacac

SEQ ID NO: 544292 - RNA, 32 nt, Human
uuuacucacaccaugcccuuugugccuuggug

SEQ ID NO: 544293 - RNA, 32 nt, Human
uuuacucacaucuucauucucuaaccacucua

SEQ ID NO: 544294 - RNA, 32 nt, Human
uuuacucagugacuguuguagcauuuuccugu

SEQ ID NO: 544295 - RNA, 32 nt, Human
uuuacucccaagacuucauugucccucuucac

SEQ ID NO: 544296 - RNA, 32 nt, Human
uuuacucccuaggaaaugcacaauuuuucugg

SEQ ID NO: 544297 - RNA, 32 nt, Human
uuuacucccugagaguccccuuucccuuucuu

SEQ ID NO: 544298 - RNA, 21 nt, Human
uuuacucucagcagcagccaa

SEQ ID NO: 544299 - RNA, 32 nt, Human
uuuacucugaaaugcaguggcauaaucucagc

SEQ ID NO: 544300 - RNA, 32 nt, Human
uuuacucugaguugacaggcgaugaucugaca

SEQ ID NO: 544301 - RNA, 32 nt, Human
uuuacucugccucaccaaacacaugcuaggau

SEQ ID NO: 544302 - RNA, 32 nt, Human
uuuacucuggaaaguguggggauggagaggau

SEQ ID NO: 544303 - RNA, 32 nt, Human
uuuacucuggauuccuccucuaccauauccgc

SEQ ID NO: 544304 - RNA, 32 nt, Human
uuuacucugggugagagauaaaucuuauaggg

SEQ ID NO: 544305 - RNA, 32 nt, Human
uuuacucuguuuacacauuuugcacuugggag

SEQ ID NO: 544306 - RNA, 32 nt, Human
uuuacucuucaggagcuuggcaucauggacug

SEQ ID NO: 544307 - RNA, 32 nt, Human
uuuacucuuuacaaaaaguaaagugagaaucc

SEQ ID NO: 544308 - RNA, 32 nt, Human
uuuacugacauggagugaagugcaauauuaua

SEQ ID NO: 544309 - RNA, 32 nt, Human
uuuacugauuuaauauuacaguguaagaaugu

SEQ ID NO: 544310 - RNA, 31 nt, Human
uuuacugcacuuucugaccaggagcuacuuu

SEQ ID NO: 544311 - RNA, 32 nt, Human
uuuacugcccuucacccaaccucucccaccuc

SEQ ID NO: 544312 - RNA, 32 nt, Human
uuuacugcucagaaccucuacuucucaucugc

SEQ ID NO: 544313 - RNA, 32 nt, Human
uuuacugcucagaauuuggagggagggagcag

SEQ ID NO: 544314 - RNA, 21 nt, Human
uuuacugcuuuguccauugga

SEQ ID NO: 544315 - RNA, 32 nt, Human
uuuacuggaagcaacaggaacuucuuaauggg

SEQ ID NO: 544316 - RNA, 32 nt, Human
uuuacuggccuacaaaucuaccuucauuccgu

SEQ ID NO: 544317 - RNA, 32 nt, Human
uuuacugggcaggcuuccuuccuccuggugau

SEQ ID NO: 544318 - RNA, 23 nt, Human
uuuacugggcgguuuccauuuga

SEQ ID NO: 544319 - RNA, 22 nt, Human
uuuacugguaguguccucauuc

SEQ ID NO: 544320 - RNA, 23 nt, Human
uuuacugguaguguucugauuug

SEQ ID NO: 544321 - RNA, 32 nt, Human
uuuacugguucagcaaaagccaggaagaacaa

SEQ ID NO: 544322 - RNA, 31 nt, Human
uuuacuguaccuucuuuauguuuagauaugc

SEQ ID NO: 544323 - RNA, 32 nt, Human
uuuacuguauuuuugcaugguuccuuguauug

SEQ ID NO: 544324 - RNA, 32 nt, Human
uuuacuguauuuuugugucuggucuucccuuu

SEQ ID NO: 544325 - RNA, 32 nt, Human
uuuacugucauugucugguuucugucccaguu

SEQ ID NO: 544326 - RNA, 32 nt, Human
uuuacugugaaaugucuaacuuugccagugcu

SEQ ID NO: 544327 - RNA, 32 nt, Human
uuuacugugagcuuuugccugccugugcuauu

SEQ ID NO: 544328 - RNA, 32 nt, Human
uuuacugugauucagagccacagucuaacuga

SEQ ID NO: 544329 - RNA, 32 nt, Human
uuuacugugugggguggcugggagacagacuu

SEQ ID NO: 544330 - RNA, 32 nt, Human
uuuacuuaacaaguaaccaguaguucaucaaa

SEQ ID NO: 544331 - RNA, 32 nt, Human
uuuacuuacauacagugacucuccagauuuua

SEQ ID NO: 544332 - RNA, 32 nt, Human
uuuacuuagugcucugaauuuacuuuuacagu

SEQ ID NO: 544333 - RNA, 32 nt, Human
uuuacuuauucacaugaaguucaaugucuugu

SEQ ID NO: 544334 - RNA, 32 nt, Human
uuuacuucaauuuuucuuuuucuauguacugg

SEQ ID NO: 544335 - RNA, 32 nt, Human
uuuacuucaguagugagggcaaugagaagcuu

SEQ ID NO: 544336 - RNA, 32 nt, Human
uuuacuucauuucaaaacuauuuccaaucaca

SEQ ID NO: 544337 - RNA, 32 nt, Human
uuuacuuccagcaucugagcucuggcucucac

SEQ ID NO: 544338 - RNA, 32 nt, Human
uuuacuuccauguggaaaaccuucaaauaaaa

SEQ ID NO: 544339 - RNA, 32 nt, Human
uuuacuuccuaauggaugugauuugcagauuu

SEQ ID NO: 544340 - RNA, 32 nt, Human
uuuacuuccucuuuucuaaucugagagguuuc

SEQ ID NO: 544341 - RNA, 32 nt, Human
uuuacuucuaucgacgcugugccuauuuguuc

SEQ ID NO: 544342 - RNA, 32 nt, Human
uuuacuucuucauucugggauauugugaaaag

SEQ ID NO: 544343 - RNA, 32 nt, Human
uuuacuugaaucugguuggccacuccucuacc

SEQ ID NO: 544344 - RNA, 32 nt, Human
uuuacuugacaggguuucaccauguuggcuag

SEQ ID NO: 544345 - RNA, 32 nt, Human
uuuacuugagcuguggucacagcugccaggua

SEQ ID NO: 544346 - RNA, 32 nt, Human
uuuacuugcuucaugauuaguaccaaaccacu

SEQ ID NO: 544347 - RNA, 32 nt, Human
uuuacuugggacagagcucuacccacaagggc

SEQ ID NO: 544348 - RNA, 32 nt, Human
uuuacuuuacauccuaaaacugccuuuuccua

SEQ ID NO: 544349 - RNA, 32 nt, Human
uuuacuuuccagaugaagagcugagccugauu

SEQ ID NO: 544350 - RNA, 32 nt, Human
uuuacuuuccauaugaauacaguggcuagguu

SEQ ID NO: 544351 - RNA, 32 nt, Human
uuuacuuucccuuuuucuaucaccuuaugucc

SEQ ID NO: 544352 - RNA, 21 nt, Human
uuuacuuucuacaggagccaa

SEQ ID NO: 544353 - RNA, 32 nt, Human
uuuacuuugauggaucuggccagagggguguu

SEQ ID NO: 544354 - RNA, 32 nt, Human
uuuacuuugcauuugauugcugugaagaugaa

SEQ ID NO: 544355 - RNA, 32 nt, Human
uuuacuuuggacuguccuuccuaaagaugcuc

SEQ ID NO: 544356 - RNA, 32 nt, Human
uuuacuuuguggaaguuguacuuuccagaaua

SEQ ID NO: 544357 - RNA, 32 nt, Human
uuuacuuuuaauguagcacagaauaguuuuaa

SEQ ID NO: 544358 - RNA, 32 nt, Human
uuuacuuuugauuaagaaaacacuuaaccuuc

SEQ ID NO: 544359 - RNA, 32 nt, Human
uuuacuuuugcacuuggagcugcuuuuaauuu

SEQ ID NO: 544360 - RNA, 32 nt, Human
uuuacuuuuguggagcauuagagucacaguuu

SEQ ID NO: 544361 - RNA, 32 nt, Human
uuuagaaaaaggugaugcauccuccucacaua

SEQ ID NO: 544362 - RNA, 32 nt, Human
uuuagaaaauauaaaccuuagaauggugaaga

SEQ ID NO: 544363 - RNA, 32 nt, Human
uuuagaaaaugagagaauucugauuggcuagu

SEQ ID NO: 544364 - RNA, 32 nt, Human
uuuagaaaaugagaugcaggauucaaggaaga

SEQ ID NO: 544365 - RNA, 32 nt, Human
uuuagaaaaugcugauuugagaacaaaaggaa

SEQ ID NO: 544366 - RNA, 32 nt, Human
uuuagaaacauguagacuaacgaaugacauaa

SEQ ID NO: 544367 - RNA, 32 nt, Human
uuuagaaacuggagagugaaggcauggaguga

SEQ ID NO: 544368 - RNA, 32 nt, Human
uuuagaaagcaugcauguaauguauguaugca

SEQ ID NO: 544369 - RNA, 32 nt, Human
uuuagaaagcauuugaaugcauuuuguuuggu

SEQ ID NO: 544370 - RNA, 32 nt, Human
uuuagaaaugcugcuagucacggugcagccuu

SEQ ID NO: 544371 - RNA, 32 nt, Human
uuuagaacagacauuucagucacugcauucuu

SEQ ID NO: 544372 - RNA, 32 nt, Human
uuuagaacagcauuguccucugaguugguuaa

SEQ ID NO: 544373 - RNA, 32 nt, Human
uuuagaacauuuuauuuauacugugaagacuu

SEQ ID NO: 544374 - RNA, 32 nt, Human
uuuagaaccaaaaauauucucucacagauuuc

SEQ ID NO: 544375 - RNA, 32 nt, Human
uuuagaacccuugucugcagccaguggggagu

SEQ ID NO: 544376 - RNA, 32 nt, Human
uuuagaaccugaccucaaggauauggcagcgc

SEQ ID NO: 544377 - RNA, 32 nt, Human
uuuagaacuaggguagaggcacuagagcacca

SEQ ID NO: 544378 - RNA, 32 nt, Human
uuuagaacugcaggagcucccugcugccucca

SEQ ID NO: 544379 - RNA, 32 nt, Human
uuuagaagacucuaccagacuguguauucauu

SEQ ID NO: 544380 - RNA, 19 nt, Human
uuuagaagcaguucuucca

SEQ ID NO: 544381 - RNA, 30 nt, Human
uuuagaagcuugcaaauuacagaaagaaua

SEQ ID NO: 544382 - RNA, 32 nt, Human
uuuagaaggcaccccugcccuccugaggucag

SEQ ID NO: 544383 - RNA, 32 nt, Human
uuuagaaguguaccuaucuaacaaacuauuau

SEQ ID NO: 544384 - RNA, 32 nt, Human
uuuagaauagugccuggcaugaaaugccuaug

SEQ ID NO: 544385 - RNA, 32 nt, Human
uuuagaaugaagacuggggaggaagcaucuua

SEQ ID NO: 544386 - RNA, 32 nt, Human
uuuagaaugaaugagucaccuugugauuuuua

SEQ ID NO: 544387 - RNA, 32 nt, Human
uuuagaaugcaauuuggcaaaaguaguaaaau

SEQ ID NO: 544388 - RNA, 32 nt, Human
uuuagaaugguucauacgucugcuuuguuugc

SEQ ID NO: 544389 - RNA, 32 nt, Human
uuuagacaaacauauauguauguaugaaugua

SEQ ID NO: 544390 - RNA, 32 nt, Human
uuuagacaaccugaaauuuauucacauauauc

SEQ ID NO: 544391 - RNA, 32 nt, Human
uuuagacaacuuggccagccgugguggcucac

SEQ ID NO: 544392 - RNA, 32 nt, Human
uuuagacaagagucucgcuuuguugcccaggc

SEQ ID NO: 544393 - RNA, 32 nt, Human
uuuagacaagcuugaaaacuugaaauuguuga

SEQ ID NO: 544394 - RNA, 32 nt, Human
uuuagacacaaaccuccccagcuccggccaag

SEQ ID NO: 544395 - RNA, 32 nt, Human
uuuagacacucucguucugucacccaggcugg

SEQ ID NO: 544396 - RNA, 32 nt, Human
uuuagacagaguuuugcucuuguugccuaggc

SEQ ID NO: 544397 - RNA, 32 nt, Human
uuuagacagcguuucgcucuuguugcccaggc

SEQ ID NO: 544398 - RNA, 32 nt, Human
uuuagacaggcagaccauggcagaguucuccc

SEQ ID NO: 544399 - RNA, 32 nt, Human
uuuagacaggucuuacucugucacccaggcug

SEQ ID NO: 544400 - RNA, 32 nt, Human
uuuagacauaugccaacuauauacgaccuuca

SEQ ID NO: 544401 - RNA, 32 nt, Human
uuuagacaucuucuacuugcucuuggccuuga

SEQ ID NO: 544402 - RNA, 32 nt, Human
uuuagaccagccugggcaacacaguaagaccc

SEQ ID NO: 544403 - RNA, 32 nt, Human
uuuagacccacugugccuucccggccucccgg

SEQ ID NO: 544404 - RNA, 32 nt, Human
uuuagacccccagggaaacagccuuccuggag

SEQ ID NO: 544405 - RNA, 32 nt, Human
uuuagacggaguuucacucuuguugcccaggc

SEQ ID NO: 544406 - RNA, 32 nt, Human
uuuagacggaguuuugcucuuguugcccaggc

SEQ ID NO: 544407 - RNA, 32 nt, Human
uuuagacuaggacuguucuacugugaagaaag

SEQ ID NO: 544408 - RNA, 32 nt, Human
uuuagacuauaucaaccuacaacuuuagucgg

SEQ ID NO: 544409 - RNA, 32 nt, Human
uuuagacucauuguaaguugccacugccaaca

SEQ ID NO: 544410 - RNA, 32 nt, Human
uuuagacucucucacagagguggcucacagag

SEQ ID NO: 544411 - RNA, 32 nt, Human
uuuagacugaaacuacacauuggcaaauagcg

SEQ ID NO: 544412 - RNA, 32 nt, Human
uuuagacugcugcugcucagcugguugcuuga

SEQ ID NO: 544413 - RNA, 32 nt, Human
uuuagacuggaccccacaauguuugcagagau

SEQ ID NO: 544414 - RNA, 32 nt, Human
uuuagacugggcaacagagcaagacccugucu

SEQ ID NO: 544415 - RNA, 32 nt, Human
uuuagacuucagcacgucacacauccugguug

SEQ ID NO: 544416 - RNA, 32 nt, Human
uuuagacuugauacaaggaaaaauucagcuug

SEQ ID NO: 544417 - RNA, 32 nt, Human
uuuagacuuuccaaaugcauccugcaaagaga

SEQ ID NO: 544418 - RNA, 25 nt, Human
uuuagagaacagccugguuaacaug

SEQ ID NO: 544419 - RNA, 32 nt, Human
uuuagagaacugguauagcuguggagagggag

SEQ ID NO: 544420 - RNA, 32 nt, Human
uuuagagaauggggguggggaggcaagaacca

SEQ ID NO: 544421 - RNA, 25 nt, Human
uuuagagaccagcccgggcaacaug

SEQ ID NO: 544422 - RNA, 32 nt, Human
uuuagagagcuuucggagaacagaacacuugg

SEQ ID NO: 544423 - RNA, 32 nt, Human
uuuagagaucugagcugucucuuaaaggggac

SEQ ID NO: 544424 - RNA, 32 nt, Human
uuuagagcaagaaaauucuguggccacccucu

SEQ ID NO: 544425 - RNA, 32 nt, Human
uuuagagcacugaaagaaacacaaagccagcc

SEQ ID NO: 544426 - RNA, 32 nt, Human
uuuagagcccgcgaagggcugucuccucgggc

SEQ ID NO: 544427 - RNA, 32 nt, Human
uuuagagccuuugauuuccuggacuggacuga

SEQ ID NO: 544428 - RNA, 32 nt, Human
uuuagagcugcuguagcuguuccuucacaaca

SEQ ID NO: 544429 - RNA, 32 nt, Human
uuuagaggaccuucccuaagggcgcagcuucg

SEQ ID NO: 544430 - RNA, 32 nt, Human
uuuagaggcccagcucaugcaucucauugccu

SEQ ID NO: 544431 - RNA, 32 nt, Human
uuuagaggcguuuuugaaaauguaaauagcau

SEQ ID NO: 544432 - RNA, 32 nt, Human
uuuagaggcuaugaagaaaacagcugcauggc

SEQ ID NO: 544433 - RNA, 32 nt, Human
uuuagaggcugaggcaggagaauugguugaac

SEQ ID NO: 544434 - RNA, 32 nt, Human
uuuagagggcagcagaggagcugucugaaaaa

SEQ ID NO: 544435 - RNA, 32 nt, Human
uuuagaggggcaggcuuaaauaaaggacuaaa

SEQ ID NO: 544436 - RNA, 32 nt, Human
uuuagaggguggcaguucacuucaccucucuu

SEQ ID NO: 544437 - RNA, 32 nt, Human
uuuagaguaagcuagccuuuugcacauuuaca

SEQ ID NO: 544438 - RNA, 32 nt, Human
uuuagagucaaaguaucucaaaccugaaucca

SEQ ID NO: 544439 - RNA, 32 nt, Human
uuuagagugaaaugaguccuauggucagacag

SEQ ID NO: 544440 - RNA, 32 nt, Human
uuuagaguguuucugggccaggauccgggccc

SEQ ID NO: 544441 - RNA, 32 nt, Human
uuuagaguuacaagccccuggaaaagggagca

SEQ ID NO: 544442 - RNA, 32 nt, Human
uuuagauauuuacuccccauuuuaugauccgg

SEQ ID NO: 544443 - RNA, 32 nt, Human
uuuagaucaagaaagcuguugaugaagacauu

SEQ ID NO: 544444 - RNA, 32 nt, Human
uuuagaucagcaccuggaauacaugacacauu

SEQ ID NO: 544445 - RNA, 32 nt, Human
uuuagauccaaucugacucucuugaaggacau

SEQ ID NO: 544446 - RNA, 32 nt, Human
uuuagaugacaaaaacaccagauugaaggaug

SEQ ID NO: 544447 - RNA, 32 nt, Human
uuuagaugaccucuuuccuuguuuuguuuuca

SEQ ID NO: 544448 - RNA, 32 nt, Human
uuuagaugagacagaguuucgcccuugucacc

SEQ ID NO: 544449 - RNA, 32 nt, Human
uuuagaugaggcaccugcggcccaaagaguca

SEQ ID NO: 544450 - RNA, 32 nt, Human
uuuagaugaucuauucaaagugugaauauuua

SEQ ID NO: 544451 - RNA, 32 nt, Human
uuuagaugcuucuggguuccaugggcgccuua

SEQ ID NO: 544452 - RNA, 32 nt, Human
uuuagauggaauuucacucuuguugcccaggc

SEQ ID NO: 544453 - RNA, 22 nt, Human
uuuagauggagccugggcaaca

SEQ ID NO: 544454 - RNA, 32 nt, Human
uuuagauggaguuucacucuuguugcccaggc

SEQ ID NO: 544455 - RNA, 32 nt, Human
uuuagauggaguuucuuuuugcccaggcugga

SEQ ID NO: 544456 - RNA, 32 nt, Human
uuuagauggaguuuggcucuugucacccaggc

SEQ ID NO: 544457 - RNA, 32 nt, Human
uuuagauggaguuuuacucuuguugcccaggc

SEQ ID NO: 544458 - RNA, 32 nt, Human
uuuagauguaguuuugcucuuguugcccaggc

SEQ ID NO: 544459 - RNA, 32 nt, Human
uuuagauguggacaguggguggacugggccca

SEQ ID NO: 544460 - RNA, 32 nt, Human
uuuagauguguaugaaauaccuguauacguua

SEQ ID NO: 544461 - RNA, 32 nt, Human
uuuagauucucccuguacuggaaagggauguc

SEQ ID NO: 544462 - RNA, 32 nt, Human
uuuagauuuaacagauagaguguggcuucauu

SEQ ID NO: 544463 - RNA, 32 nt, Human
uuuagcaaacauuugcuuuucuuuuuggaagu

SEQ ID NO: 544464 - RNA, 21 nt, Human
uuuagcaaagaacucuuaccu

SEQ ID NO: 544465 - RNA, 18 nt, Human
uuuagcaaccaagcauga

SEQ ID NO: 544466 - RNA, 32 nt, Human
uuuagcaagguaacaguugcccagggcaguac

SEQ ID NO: 544467 - RNA, 32 nt, Human
uuuagcaauaucaucaggucucuugcagaguu

SEQ ID NO: 544468 - RNA, 32 nt, Human
uuuagcaaucuuacgagugaaauguucuggug

SEQ ID NO: 544469 - RNA, 32 nt, Human
uuuagcaaugcagaaaggaauuuuuaaaaauc

SEQ ID NO: 544470 - RNA, 19 nt, Human
uuuagcaauuaaauucuag

SEQ ID NO: 544471 - RNA, 32 nt, Human
uuuagcacaaaccaagcacaaaaguccuccug

SEQ ID NO: 544472 - RNA, 32 nt, Human
uuuagcacaaagugccuucuguuucacagcug

SEQ ID NO: 544473 - RNA, 32 nt, Human
uuuagcacagauuuguuuauguguucagauuu

SEQ ID NO: 544474 - RNA, 32 nt, Human
uuuagcaccagggaaggggacaaggacuaggg

SEQ ID NO: 544475 - RNA, 32 nt, Human
uuuagcagacaggguuucaccauguuggccag

SEQ ID NO: 544476 - RNA, 32 nt, Human
uuuagcagcaucacuggccucuacccauuagc

SEQ ID NO: 544477 - RNA, 32 nt, Human
uuuagcagccaaggaugggaauuacacagcga

SEQ ID NO: 544478 - RNA, 32 nt, Human
uuuagcaggaggaucacuugagcccaggaguu

SEQ ID NO: 544479 - RNA, 32 nt, Human
uuuagcaggcugguguuaaggcuguaggagga

SEQ ID NO: 544480 - RNA, 32 nt, Human
uuuagcagugccucuguuuacaccauaagaug

SEQ ID NO: 544481 - RNA, 19 nt, Human
uuuagcaguguguaaagua

SEQ ID NO: 544482 - RNA, 32 nt, Human
uuuagcaguuuuugagaauguguuugauauca

SEQ ID NO: 544483 - RNA, 32 nt, Human
uuuagcauccaccaauuuucacugcauuuugc

SEQ ID NO: 544484 - RNA, 32 nt, Human
uuuagcaucucaaauuccaacugaaaucauuu

SEQ ID NO: 544485 - RNA, 32 nt, Human
uuuagcaucuucugucaugagaaguggcgauc

SEQ ID NO: 544486 - RNA, 32 nt, Human
uuuagcaucuucuuuaccuccaguguuccugc

SEQ ID NO: 544487 - RNA, 32 nt, Human
uuuagcaucuuuacagauggagaggacagagu

SEQ ID NO: 544488 - RNA, 32 nt, Human
uuuagcauuagcucugugugagcuccugccgg

SEQ ID NO: 544489 - RNA, 32 nt, Human
uuuagcauuaguccauuucugcugcuaacaau

SEQ ID NO: 544490 - RNA, 32 nt, Human
uuuagcauugucuuguucugucccuuccacuu

SEQ ID NO: 544491 - RNA, 32 nt, Human
uuuagccaaagaccuugaaaacuacaguugug

SEQ ID NO: 544492 - RNA, 32 nt, Human
uuuagccaaggaguucuagccugcagugaacu

SEQ ID NO: 544493 - RNA, 32 nt, Human
uuuagccaaugccacucaccaaaucuuugcac

SEQ ID NO: 544494 - RNA, 32 nt, Human
uuuagccaaugucuuccuagguggggcuagga

SEQ ID NO: 544495 - RNA, 32 nt, Human
uuuagccaauucgagggcuccuugugguggga

SEQ ID NO: 544496 - RNA, 32 nt, Human
uuuagccacagcuguuuuaagacuucugaucu

SEQ ID NO: 544497 - RNA, 32 nt, Human
uuuagccagagaaugguucaaaugucuuacag

SEQ ID NO: 544498 - RNA, 32 nt, Human
uuuagccagcagugcccugcccugcccugcag

SEQ ID NO: 544499 - RNA, 32 nt, Human
uuuagccaguuugccagcaagcgcauccuagc

SEQ ID NO: 544500 - RNA, 32 nt, Human
uuuagccaugccugcuccucugccuggaccag

SEQ ID NO: 544501 - RNA, 22 nt, Human
uuuagccauucugguucuaguc

SEQ ID NO: 544502 - RNA, 32 nt, Human
uuuagccauucuuaucuccucccuucagaucc

SEQ ID NO: 544503 - RNA, 32 nt, Human
uuuagcccaggaauucgagaccagccugggca

SEQ ID NO: 544504 - RNA, 32 nt, Human
uuuagcccaggagguccagaccagccugggca

SEQ ID NO: 544505 - RNA, 32 nt, Human
uuuagcccaggaguuaaagaccagccugggca

SEQ ID NO: 544506 - RNA, 32 nt, Human
uuuagcccaggaguuugaggcugcggugaguu

SEQ ID NO: 544507 - RNA, 32 nt, Human
uuuagcccaugaggaggaugugaccgggacug

SEQ ID NO: 544508 - RNA, 32 nt, Human
uuuagccccaaagcucuucuaguucucaccug

SEQ ID NO: 544509 - RNA, 32 nt, Human
uuuagcccccagcuucccagcaggcaacucaa

SEQ ID NO: 544510 - RNA, 32 nt, Human
uuuagcccguugucugucucuaguuucuuucu

SEQ ID NO: 544511 - RNA, 32 nt, Human
uuuagcccugcucuggcuucugcagcagcaga

SEQ ID NO: 544512 - RNA, 32 nt, Human
uuuagccugaaccuugaagguguuuguucaga

SEQ ID NO: 544513 - RNA, 24 nt, Human
uuuagccugcauggcagggagagg

SEQ ID NO: 544514 - RNA, 32 nt, Human
uuuagccugggcgacagagcgagaccuugucu

SEQ ID NO: 544515 - RNA, 32 nt, Human
uuuagccugggugaaaaagugagacccuaucu

SEQ ID NO: 544516 - RNA, 32 nt, Human
uuuagccugggugacagagcgagacucugucu

SEQ ID NO: 544517 - RNA, 32 nt, Human
uuuagcgagccuggagggaagggaaggcugag

SEQ ID NO: 544518 - RNA, 32 nt, Human
uuuagcggugaauuacuccuucuggcuaagag

SEQ ID NO: 544519 - RNA, 32 nt, Human
uuuagcgugcucacugaccugccuguagcccc

SEQ ID NO: 544520 - RNA, 32 nt, Human
uuuagcuacuaaaaauuucuauuaaaauuauu

SEQ ID NO: 544521 - RNA, 32 nt, Human
uuuagcuacuuuggggaggagggaaggugcug

SEQ ID NO: 544522 - RNA, 32 nt, Human
uuuagcuagaccuuugcuuccuucuugccagc

SEQ ID NO: 544523 - RNA, 32 nt, Human
uuuagcuaucaaccuaauuuuccucuuaguug

SEQ ID NO: 544524 - RNA, 32 nt, Human
uuuagcucuccucucaguugaaugcaaugcca

SEQ ID NO: 544525 - RNA, 32 nt, Human
uuuagcucuggcuuacucuucucuccaccauu

SEQ ID NO: 544526 - RNA, 32 nt, Human
uuuagcucuguggaauucagugacaaaauggg

SEQ ID NO: 544527 - RNA, 32 nt, Human
uuuagcugaagaauuguauuacauuuggagag

SEQ ID NO: 544528 - RNA, 32 nt, Human
uuuagcugcaguaucaauguggcauaaauacu

SEQ ID NO: 544529 - RNA, 32 nt, Human
uuuagcugcugccuccagccucuggcuugaga

SEQ ID NO: 544530 - RNA, 32 nt, Human
uuuagcuguaaaccaaguuggaagcuauucgg

SEQ ID NO: 544531 - RNA, 32 nt, Human
uuuagcuguagaucaagcuauuugggguguuu

SEQ ID NO: 544532 - RNA, 23 nt, Human
uuuagcuuagggggaggguggga

SEQ ID NO: 544533 - RNA, 32 nt, Human
uuuagcuuccugcuuauuguuacuggacauuu

SEQ ID NO: 544534 - RNA, 32 nt, Human
uuuagcuugccugcaggaucaggaaaguuuga

SEQ ID NO: 544535 - RNA, 32 nt, Human
uuuagcuuucagagagaaacagcaggauugcu

SEQ ID NO: 544536 - RNA, 32 nt, Human
uuuagcuuucucuccccucccuuugaaugaga

SEQ ID NO: 544537 - RNA, 32 nt, Human
uuuagcuuuuagauuuuuaugugucuuugaca

SEQ ID NO: 544538 - RNA, 32 nt, Human
uuuaggaaaaacaaaacaacagacuucauccu

SEQ ID NO: 544539 - RNA, 32 nt, Human
uuuaggaaacacacagcauacagacuuacccc

SEQ ID NO: 544540 - RNA, 32 nt, Human
uuuaggaacugagaaagaaccugccuaagcag

SEQ ID NO: 544541 - RNA, 32 nt, Human
uuuaggaagcauuugaaugcauuuuguuuggu

SEQ ID NO: 544542 - RNA, 32 nt, Human
uuuaggaaguaaaauuugcuucauggucauga

SEQ ID NO: 544543 - RNA, 32 nt, Human
uuuaggaauaagaugguagaauaccugacaga

SEQ ID NO: 544544 - RNA, 32 nt, Human
uuuaggaauauguaagaaacucaacacauaau

SEQ ID NO: 544545 - RNA, 32 nt, Human
uuuaggacacguuuaacuuucuaggccuccaa

SEQ ID NO: 544546 - RNA, 32 nt, Human
uuuaggaccaagccccuuaacaacucaggccu

SEQ ID NO: 544547 - RNA, 32 nt, Human
uuuaggacccccagaccugugaaggugggagc

SEQ ID NO: 544548 - RNA, 32 nt, Human
uuuaggaccugauggacaaagcaggagauuca

SEQ ID NO: 544549 - RNA, 32 nt, Human
uuuaggacgaaagaaguauggagcagugggau

SEQ ID NO: 544550 - RNA, 32 nt, Human
uuuaggacucagcagacccagcaagaggcauc

SEQ ID NO: 544551 - RNA, 31 nt, Human
uuuaggacuuuuccauagugccaaagccaua

SEQ ID NO: 544552 - RNA, 32 nt, Human
uuuaggagaaaagcuugcuucaggguccuuag

SEQ ID NO: 544553 - RNA, 32 nt, Human
uuuaggagaagaggagagacaggcaggaaagg

SEQ ID NO: 544554 - RNA, 32 nt, Human
uuuaggagagaacauuuaagccacucagguau

SEQ ID NO: 544555 - RNA, 32 nt, Human
uuuaggagauaaaaacagcuuuggggacuggu

SEQ ID NO: 544556 - RNA, 32 nt, Human
uuuaggagauuaucaagcugguugucauucau

SEQ ID NO: 544557 - RNA, 31 nt, Human
uuuaggagcuaaccuccacagaugcugauag

SEQ ID NO: 544558 - RNA, 32 nt, Human
uuuaggaguuugaauucuuacucucaucagac

SEQ ID NO: 544559 - RNA, 21 nt, Human
uuuaggaucagccuacgauau

SEQ ID NO: 544560 - RNA, 21 nt, Human
uuuaggaucaggcugaauaug

SEQ ID NO: 544561 - RNA, 32 nt, Human
uuuaggaugaaaacuaaaggacucauugccuu

SEQ ID NO: 544562 - RNA, 32 nt, Human
uuuaggauguacagccuaguguuaacauucuu

SEQ ID NO: 544563 - RNA, 32 nt, Human
uuuaggauuugagcuguucuggaacacauugc

SEQ ID NO: 544564 - RNA, 32 nt, Human
uuuaggcaacacauucucauuccugucauuau

SEQ ID NO: 544565 - RNA, 32 nt, Human
uuuaggcaccagugauuucacccuucugagcc

SEQ ID NO: 544566 - RNA, 32 nt, Human
uuuaggcacucaauaaauguugacuaauuuuu

SEQ ID NO: 544567 - RNA, 32 nt, Human
uuuaggcagagaacauucaugugucauaugug

SEQ ID NO: 544568 - RNA, 32 nt, Human
uuuaggcaggcuuccuggaacuacuguuuuac

SEQ ID NO: 544569 - RNA, 32 nt, Human
uuuaggcaugagccaccacaucuggccaauag

SEQ ID NO: 544570 - RNA, 32 nt, Human
uuuaggccagcucacauuuauuuggaaauuac

SEQ ID NO: 544571 - RNA, 20 nt, Human
uuuaggccccuuuccuuccc

SEQ ID NO: 544572 - RNA, 32 nt, Human
uuuaggccgcuagaccguaagcucuuugaguu

SEQ ID NO: 544573 - RNA, 32 nt, Human
uuuaggccucuggaugacugcgggcgggccug

SEQ ID NO: 544574 - RNA, 32 nt, Human
uuuaggcuauggguuugagaccagccuggcaa

SEQ ID NO: 544575 - RNA, 19 nt, Human
uuuaggcugggcgcagugg

SEQ ID NO: 544576 - RNA, 19 nt, Human
uuuaggcugggugcagugg

SEQ ID NO: 544577 - RNA, 32 nt, Human
uuuaggcuggucugggucauggggaagcgucc

SEQ ID NO: 544578 - RNA, 21 nt, Human
uuuaggcuucuuggcaacaua

SEQ ID NO: 544579 - RNA, 32 nt, Human
uuuaggcuugcagccacgguacggcagccgga

SEQ ID NO: 544580 - RNA, 32 nt, Human
uuuagggaacaggguugacacagcagggcuag

SEQ ID NO: 544581 - RNA, 32 nt, Human
uuuagggacuacccagauuacuccaggauaau

SEQ ID NO: 544582 - RNA, 32 nt, Human
uuuagggacuuguccugguucaucuuaguuaa

SEQ ID NO: 544583 - RNA, 32 nt, Human
uuuagggagaacgggaauucagacaagcugca

SEQ ID NO: 544584 - RNA, 32 nt, Human
uuuagggagcugggacaccugguccugcuagc

SEQ ID NO: 544585 - RNA, 20 nt, Human
uuuagggagggugacuggga

SEQ ID NO: 544586 - RNA, 32 nt, Human
uuuagggaguuaccuguuuucaucucgaggug

SEQ ID NO: 544587 - RNA, 32 nt, Human
uuuagggauacuuuguucucaccacugucccu

SEQ ID NO: 544588 - RNA, 32 nt, Human
uuuagggaugagacuggggcccagggaggggc

SEQ ID NO: 544589 - RNA, 27 nt, Human
uuuagggauugauugucugcuggggug

SEQ ID NO: 544590 - RNA, 21 nt, Human
uuuagggauuugcuugggaua

SEQ ID NO: 544591 - RNA, 32 nt, Human
uuuagggcagaugacacuuuuucccacccuuu

SEQ ID NO: 544592 - RNA, 31 nt, Human
uuuagggcauuuuucugacucaugaaaagag

SEQ ID NO: 544593 - RNA, 32 nt, Human
uuuagggcccuccccacccacacccacagguc

SEQ ID NO: 544594 - RNA, 32 nt, Human
uuuagggcccugauuugcugggcaguuuuucu

SEQ ID NO: 544595 - RNA, 32 nt, Human
uuuagggccuuaagccccugaggguccuggug

SEQ ID NO: 544596 - RNA, 32 nt, Human
uuuagggcuuaaaauaaauuaugguucuauga

SEQ ID NO: 544597 - RNA, 32 nt, Human
uuuagggcuuuguuacagaugugugaccaagg

SEQ ID NO: 544598 - RNA, 32 nt, Human
uuuaggggaacugucuuccuccgcaggcgcga

SEQ ID NO: 544599 - RNA, 32 nt, Human
uuuaggggacugagaaagcacaggcuucauga

SEQ ID NO: 544600 - RNA, 32 nt, Human
uuuaggggaggcaggcaggugggugagcagca

SEQ ID NO: 544601 - RNA, 32 nt, Human
uuuaggggagggcagaggccugcaguuuggcu

SEQ ID NO: 544602 - RNA, 32 nt, Human
uuuaggggauguggggaccaggagaaagucag

SEQ ID NO: 544603 - RNA, 24 nt, Human
uuuaggggccauauacuacauuau

SEQ ID NO: 544604 - RNA, 32 nt, Human
uuuaggggccgagacagguggaucaccugagg

SEQ ID NO: 544605 - RNA, 32 nt, Human
uuuagggggaaggugcuccaaagcccucuacu

SEQ ID NO: 544606 - RNA, 32 nt, Human
uuuagggggcugagaugcuccaugccuuuccc

SEQ ID NO: 544607 - RNA, 28 nt, Human
uuuagggggucaauaaagcugaaauugu

SEQ ID NO: 544608 - RNA, 32 nt, Human
uuuagggguggggaagugucagcaaggugucu

SEQ ID NO: 544609 - RNA, 32 nt, Human
uuuagggguguggaggaggggaagggaggaau

SEQ ID NO: 544610 - RNA, 32 nt, Human
uuuaggguacaagaagccuguucuguccagcu

SEQ ID NO: 544611 - RNA, 21 nt, Human
uuuaggguacaugggcaacau

SEQ ID NO: 544612 - RNA, 21 nt, Human
uuuaggguuugaaaacuuguc

SEQ ID NO: 544613 - RNA, 22 nt, Human
uuuaggguuuucucuugguugu

SEQ ID NO: 544614 - RNA, 32 nt, Human
uuuagguaagagucauaucacaaaaagccauu

SEQ ID NO: 544615 - RNA, 18 nt, Human
uuuagguaggcagggccu

SEQ ID NO: 544616 - RNA, 32 nt, Human
uuuagguaguagaaucucagcacuuuguuuca

SEQ ID NO: 544617 - RNA, 32 nt, Human
uuuaggucaggagaucaagaccagcugggcca

SEQ ID NO: 544618 - RNA, 32 nt, Human
uuuagguccaauaagagcucugaagauaaaaa

SEQ ID NO: 544619 - RNA, 32 nt, Human
uuuagguccugcugccccugcugccucagccc

SEQ ID NO: 544620 - RNA, 21 nt, Human
uuuaggugauccgcccagcuu

SEQ ID NO: 544621 - RNA, 31 nt, Human
uuuaggugcaucucugggaccuccucuuucu

SEQ ID NO: 544622 - RNA, 32 nt, Human
uuuagguggaguuucacucuguugcccaggcu

SEQ ID NO: 544623 - RNA, 32 nt, Human
uuuaggugggcugugagggccaacgcuugaca

SEQ ID NO: 544624 - RNA, 32 nt, Human
uuuaggugugcaccaccaugccuggcuaauuu

SEQ ID NO: 544625 - RNA, 32 nt, Human
uuuagguucaaauuaugccaagaauuuuagau

SEQ ID NO: 544626 - RNA, 32 nt, Human
uuuagguuuccagagaagcauacauaaccuag

SEQ ID NO: 544627 - RNA, 32 nt, Human
uuuagguuucccucccuuccccaaaccauaca

SEQ ID NO: 544628 - RNA, 32 nt, Human
uuuaguaaacaguauugaucuccuggagugag

SEQ ID NO: 544629 - RNA, 32 nt, Human
uuuaguaaagggaucagccuucauggccauca

SEQ ID NO: 544630 - RNA, 32 nt, Human
uuuaguaaggagagauuagaagacaacaggca

SEQ ID NO: 544631 - RNA, 32 nt, Human
uuuaguaauccuguuugaggcugcaguguggc

SEQ ID NO: 544632 - RNA, 23 nt, Human
uuuaguaauggaaacucuuaccu

SEQ ID NO: 544633 - RNA, 32 nt, Human
uuuaguacccagacguuuuucauuugauuaag

SEQ ID NO: 544634 - RNA, 32 nt, Human
uuuaguacugucuccccuuuaccagcaaaccu

SEQ ID NO: 544635 - RNA, 32 nt, Human
uuuaguacuuacccuucucagguuccucagug

SEQ ID NO: 544636 - RNA, 32 nt, Human
uuuaguagaaacaggcuuucaccauguuggcc

SEQ ID NO: 544637 - RNA, 32 nt, Human
uuuaguagagacaggguuucuccauguugguc

SEQ ID NO: 544638 - RNA, 31 nt, Human
uuuaguagagacgggguuucacuguggucuc

SEQ ID NO: 544639 - RNA, 32 nt, Human
uuuaguagagacgggguuucacuguggucuca

SEQ ID NO: 544640 - RNA, 32 nt, Human
uuuaguagagacggguucaccauguugcccag

SEQ ID NO: 544641 - RNA, 32 nt, Human
uuuaguagagacgguguuucacuguguuagcc

SEQ ID NO: 544642 - RNA, 32 nt, Human
uuuaguagagacgguuucaccaugucggccag

SEQ ID NO: 544643 - RNA, 32 nt, Human
uuuaguagagacgguuucaccguguuagccag

SEQ ID NO: 544644 - RNA, 32 nt, Human
uuuaguagagaugguuucaccauguuggccag

SEQ ID NO: 544645 - RNA, 32 nt, Human
uuuaguagccucaguucuuccucuccuucuuu

SEQ ID NO: 544646 - RNA, 32 nt, Human
uuuaguagggaccugcucugugcucacaccuc

SEQ ID NO: 544647 - RNA, 32 nt, Human
uuuaguauauaaggagaauaugcauuauaugu

SEQ ID NO: 544648 - RNA, 32 nt, Human
uuuaguaugugauacuaauuaagauuacuuuu

SEQ ID NO: 544649 - RNA, 32 nt, Human
uuuaguauuggaaacuccuacuucccuuuuca

SEQ ID NO: 544650 - RNA, 31 nt, Human
uuuagucaccugaagaugguuggagaggccc

SEQ ID NO: 544651 - RNA, 32 nt, Human
uuuagucauucuauaggaucaugugaaaauau

SEQ ID NO: 544652 - RNA, 32 nt, Human
uuuagucccaccucuuacuuccugccucaguc

SEQ ID NO: 544653 - RNA, 32 nt, Human
uuuaguccucccugcccugcccacugccugga

SEQ ID NO: 544654 - RNA, 32 nt, Human
uuuagucuacaggugaauccagcagcuccaga

SEQ ID NO: 544655 - RNA, 23 nt, Human
uuuagucuagccugagcaauaua

SEQ ID NO: 544656 - RNA, 32 nt, Human
uuuagucugaagauggcggccucagcagcgcg

SEQ ID NO: 544657 - RNA, 24 nt, Human
uuuagucugggugacagagcaaga

SEQ ID NO: 544658 - RNA, 32 nt, Human
uuuagucugggugacagagcaagacccugucu

SEQ ID NO: 544659 - RNA, 32 nt, Human
uuuagugaggggauuggaauccccaaaaagau

SEQ ID NO: 544660 - RNA, 32 nt, Human
uuuagugaugccuccccucuuuaaauaccugu

SEQ ID NO: 544661 - RNA, 32 nt, Human
uuuagugcaaaaaguuuacaacuacagucuuu

SEQ ID NO: 544662 - RNA, 32 nt, Human
uuuagugcaaacaugcaccagcaccagaagga

SEQ ID NO: 544663 - RNA, 32 nt, Human
uuuagugcauuuccuccugccuuugcuuguuc

SEQ ID NO: 544664 - RNA, 32 nt, Human
uuuagugccagccuaggcacaacuuguccugg

SEQ ID NO: 544665 - RNA, 32 nt, Human
uuuagugcccuccugagugacugcgucaggca

SEQ ID NO: 544666 - RNA, 32 nt, Human
uuuagugccguuucuaguauauuccuguaaau

SEQ ID NO: 544667 - RNA, 32 nt, Human
uuuagugcugcaucuuauagcacuuugaaaua

SEQ ID NO: 544668 - RNA, 32 nt, Human
uuuagugcuuaucuaauuugugccucacugga

SEQ ID NO: 544669 - RNA, 32 nt, Human
uuuagugcuugcccccugcucucuccugucgu

SEQ ID NO: 544670 - RNA, 32 nt, Human
uuuagugcuugucagcauuuuuccaugaggac

SEQ ID NO: 544671 - RNA, 32 nt, Human
uuuagugcuuuuauauucauuuccuugcauuu

SEQ ID NO: 544672 - RNA, 32 nt, Human
uuuaguggaaacaaaugguugauggauccaga

SEQ ID NO: 544673 - RNA, 32 nt, Human
uuuaguggacaggguuucaccauguuggccag

SEQ ID NO: 544674 - RNA, 32 nt, Human
uuuaguggaguuggagggaagcugcgaggagg

SEQ ID NO: 544675 - RNA, 32 nt, Human
uuuaguggauggcuuucuuuuguauuuuuaug

SEQ ID NO: 544676 - RNA, 32 nt, Human
uuuaguggcgugugguucauucacaaagcugu

SEQ ID NO: 544677 - RNA, 25 nt, Human
uuuagugggcuuuggcagggcgggg

SEQ ID NO: 544678 - RNA, 32 nt, Human
uuuaguggggaacgcagagaacuuugauccau

SEQ ID NO: 544679 - RNA, 22 nt, Human
uuuagugggucacagagcggga

SEQ ID NO: 544680 - RNA, 32 nt, Human
uuuaguggucuguuuucuacuucaguauucua

SEQ ID NO: 544681 - RNA, 32 nt, Human
uuuagugguuuuauguggauaugccacaaaac

SEQ ID NO: 544682 - RNA, 32 nt, Human
uuuaguguaauuccuaccucauuugggauaaa

SEQ ID NO: 544683 - RNA, 32 nt, Human
uuuagugucaauacuaaugcucuaauaaugua

SEQ ID NO: 544684 - RNA, 32 nt, Human
uuuagugucccaaagauaucuuagauaaacua

SEQ ID NO: 544685 - RNA, 32 nt, Human
uuuaguuauuuuaguagagauaggguuucacc

SEQ ID NO: 544686 - RNA, 32 nt, Human
uuuaguucaggaguuugaaaccagccugggca

SEQ ID NO: 544687 - RNA, 32 nt, Human
uuuaguucauaccugagcuaagaaggauaauu

SEQ ID NO: 544688 - RNA, 32 nt, Human
uuuaguucauucugccuuuccuauuuguucca

SEQ ID NO: 544689 - RNA, 32 nt, Human
uuuaguucauuuucuguguugacauuugcaau

SEQ ID NO: 544690 - RNA, 32 nt, Human
uuuaguucuuucagaucuuugaaugccucuaa

SEQ ID NO: 544691 - RNA, 32 nt, Human
uuuaguugcuuagccaagcugccugagagcug

SEQ ID NO: 544692 - RNA, 32 nt, Human
uuuaguugggcagugcucccacccacccucca

SEQ ID NO: 544693 - RNA, 32 nt, Human
uuuaguuucacacauacauaguaccaugauuu

SEQ ID NO: 544694 - RNA, 32 nt, Human
uuuaguuuccaaccuucuccccaacccuugga

SEQ ID NO: 544695 - RNA, 32 nt, Human
uuuaguuugccuggagcuugaaaggagaaagc

SEQ ID NO: 544696 - RNA, 32 nt, Human
uuuaguuugguggggguggggguggggguggg

SEQ ID NO: 544697 - RNA, 32 nt, Human
uuuaguuuguuaaugucugaaaugaauaaaaa

SEQ ID NO: 544698 - RNA, 32 nt, Human
uuuaguuuuaacaacaguaaauugucuaccaa

SEQ ID NO: 544699 - RNA, 32 nt, Human
uuuaguuuuaggacacauuuaugcagaugagc

SEQ ID NO: 544700 - RNA, 32 nt, Human
uuuaguuuugagacauggucucauucugucac

SEQ ID NO: 544701 - RNA, 32 nt, Human
uuuaguuuugcacuugguuuucuauaaaguac

SEQ ID NO: 544702 - RNA, 32 nt, Human
uuuaguuuuucccauucgcuugcccuggccuc

SEQ ID NO: 544703 - RNA, 32 nt, Human
uuuauaaaaaggaaaagaaauauacaaacuuu

SEQ ID NO: 544704 - RNA, 32 nt, Human
uuuauaaaaggcagaaauagcacuccauuaac

SEQ ID NO: 544705 - RNA, 32 nt, Human
uuuauaaacaacagaaauuuguuucucacagu

SEQ ID NO: 544706 - RNA, 32 nt, Human
uuuauaaacucaaauuggcaccuacugaauua

SEQ ID NO: 544707 - RNA, 32 nt, Human
uuuauaaacucucugcugcugagcuuggggcc

SEQ ID NO: 544708 - RNA, 32 nt, Human
uuuauaaacugaagccaacugugaauaaacug

SEQ ID NO: 544709 - RNA, 32 nt, Human
uuuauaaagaaaaauagguucaauggacccac

SEQ ID NO: 544710 - RNA, 32 nt, Human
uuuauaaagacaggguuuuuccauguugccca

SEQ ID NO: 544711 - RNA, 32 nt, Human
uuuauaaauacagugugucuucuuuuauucac

SEQ ID NO: 544712 - RNA, 32 nt, Human
uuuauaaauauauaaauacauguauguauguc

SEQ ID NO: 544713 - RNA, 32 nt, Human
uuuauaaauauguauaauuaugauguaaaaua

SEQ ID NO: 544714 - RNA, 32 nt, Human
uuuauaaaugcuauaaagaaauauuguguuuc

SEQ ID NO: 544715 - RNA, 32 nt, Human
uuuauaaaugucauuugcaaccaaaugaagua

SEQ ID NO: 544716 - RNA, 32 nt, Human
uuuauaaauguugcuuucugauuuuuaucaga

SEQ ID NO: 544717 - RNA, 32 nt, Human
uuuauaacacaaaacacaacuuacagaaguug

SEQ ID NO: 544718 - RNA, 32 nt, Human
uuuauaacagcaguauuuauccugguuuaauu

SEQ ID NO: 544719 - RNA, 32 nt, Human
uuuauaaccagaugguuccuuucacaacccug

SEQ ID NO: 544720 - RNA, 32 nt, Human
uuuauaaccccagccugaccugagacugucgc

SEQ ID NO: 544721 - RNA, 32 nt, Human
uuuauaacugacuuuuggauucccaagucauu

SEQ ID NO: 544722 - RNA, 32 nt, Human
uuuauaacuguacuucuggugacuguacaguu

SEQ ID NO: 544723 - RNA, 32 nt, Human
uuuauaagaagaggaagagacaucaguaaugc

SEQ ID NO: 544724 - RNA, 32 nt, Human
uuuauaagauguaauuauuugagaaacaagug

SEQ ID NO: 544725 - RNA, 32 nt, Human
uuuauaagcacauuguccccucauguuuccua

SEQ ID NO: 544726 - RNA, 30 nt, Human
uuuauaagcuugcaaguaacagacaagaug

SEQ ID NO: 544727 - RNA, 32 nt, Human
uuuauaaggagagacaccagagagaugaucuc

SEQ ID NO: 544728 - RNA, 32 nt, Human
uuuauaagugaucaguuaaugccuaagaguga

SEQ ID NO: 544729 - RNA, 32 nt, Human
uuuauaauauagaaguauagcuuuauaaagau

SEQ ID NO: 544730 - RNA, 32 nt, Human
uuuauaaucuauaugcaauuucaugccauuca

SEQ ID NO: 544731 - RNA, 32 nt, Human
uuuauaaugauuauaauuuacaugcuuauuuu

SEQ ID NO: 544732 - RNA, 32 nt, Human
uuuauaauuauuuucuugacuuuuggcuauaa

SEQ ID NO: 544733 - RNA, 32 nt, Human
uuuauaauucauaaccauagccucgaucauca

SEQ ID NO: 544734 - RNA, 32 nt, Human
uuuauaauugacacacucucucccucuccacu

SEQ ID NO: 544735 - RNA, 32 nt, Human
uuuauaauuggccuggugugguggcccacgcc

SEQ ID NO: 544736 - RNA, 32 nt, Human
uuuauaauugugucuaaagaaaauuaugaacu

SEQ ID NO: 544737 - RNA, 32 nt, Human
uuuauacaaagcccuccagccuguuugugggg

SEQ ID NO: 544738 - RNA, 32 nt, Human
uuuauacaaaggagggccgcugaaggacaaac

SEQ ID NO: 544739 - RNA, 19 nt, Human
uuuauacaacgcugucaua

SEQ ID NO: 544740 - RNA, 21 nt, Human
uuuauacaacuuauuuacuca

SEQ ID NO: 544741 - RNA, 32 nt, Human
uuuauacagaaaucuugugaaaccacugccca

SEQ ID NO: 544742 - RNA, 32 nt, Human
uuuauacaguauaucagcugagucaugauauu

SEQ ID NO: 544743 - RNA, 32 nt, Human
uuuauacaguuuuccuuuccuucaccuuugua

SEQ ID NO: 544744 - RNA, 32 nt, Human
uuuauacaucucuucagggaagagagaaccaa

SEQ ID NO: 544745 - RNA, 32 nt, Human
uuuauacaucuuagggagacacaagaucagua

SEQ ID NO: 544746 - RNA, 32 nt, Human
uuuauacaugagaaacagccuucaacaaguau

SEQ ID NO: 544747 - RNA, 32 nt, Human
uuuauaccaccuugacccauuugcuacauucc

SEQ ID NO: 544748 - RNA, 32 nt, Human
uuuauaccauggcaaggccuuuucuuucacaa

SEQ ID NO: 544749 - RNA, 32 nt, Human
uuuauacccacacagcaacugguccacugcuu

SEQ ID NO: 544750 - RNA, 32 nt, Human
uuuauacccucuggcagagcaaaggaacaagg

SEQ ID NO: 544751 - RNA, 32 nt, Human
uuuauacccuugcuguuguucagucuaaucau

SEQ ID NO: 544752 - RNA, 32 nt, Human
uuuauaccuucuaggagcuccuauugggagac

SEQ ID NO: 544753 - RNA, 32 nt, Human
uuuauacgcuuucccacucaugacaugccugc

SEQ ID NO: 544754 - RNA, 32 nt, Human
uuuauacguaaucacuccugccccaacacaca

SEQ ID NO: 544755 - RNA, 32 nt, Human
uuuauacguaggguuguguccauuuccucgug

SEQ ID NO: 544756 - RNA, 32 nt, Human
uuuauacuauagccacaauucugucaaagaua

SEQ ID NO: 544757 - RNA, 32 nt, Human
uuuauacucccuccuccggccuuuccuuguac

SEQ ID NO: 544758 - RNA, 23 nt, Human
uuuauacuggagagaaacucuac

SEQ ID NO: 544759 - RNA, 32 nt, Human
uuuauacuguauuucaaagaaguuguuugagg

SEQ ID NO: 544760 - RNA, 32 nt, Human
uuuauacuguuuuguucacuguauuuaguaga

SEQ ID NO: 544761 - RNA, 32 nt, Human
uuuauacuuaacaucagaucuuuucuauaaua

SEQ ID NO: 544762 - RNA, 32 nt, Human
uuuauacuuaacugagacauuuugucaaggcu

SEQ ID NO: 544763 - RNA, 32 nt, Human
uuuauagaaagcccagugacaugggccagcag

SEQ ID NO: 544764 - RNA, 32 nt, Human
uuuauagaaagcuucaauagaacuguuucaac

SEQ ID NO: 544765 - RNA, 32 nt, Human
uuuauagaaaugcagaaguuugggcucugcuc

SEQ ID NO: 544766 - RNA, 32 nt, Human
uuuauagagacaggagucucacauuguucccc

SEQ ID NO: 544767 - RNA, 32 nt, Human
uuuauagagacagggucgcacuauguugcccg

SEQ ID NO: 544768 - RNA, 32 nt, Human
uuuauagagacagggucucccucagucgcuca

SEQ ID NO: 544769 - RNA, 32 nt, Human
uuuauagagacagggucuugcuguguuaccca

SEQ ID NO: 544770 - RNA, 32 nt, Human
uuuauagagacaggguuucaccguguuggcca

SEQ ID NO: 544771 - RNA, 32 nt, Human
uuuauagagacaggguuucgccauguugcaca

SEQ ID NO: 544772 - RNA, 32 nt, Human
uuuauagauaaagaugguaagguaggauaagu

SEQ ID NO: 544773 - RNA, 32 nt, Human
uuuauagcaaaacuguuaagcugcucgagucu

SEQ ID NO: 544774 - RNA, 32 nt, Human
uuuauagccaucauguuucuaagagacuugga

SEQ ID NO: 544775 - RNA, 32 nt, Human
uuuauagcccuaggggugguaugacccaaagg

SEQ ID NO: 544776 - RNA, 32 nt, Human
uuuauagccuacauuuuaauuucuugauaucu

SEQ ID NO: 544777 - RNA, 32 nt, Human
uuuauagcucacugcaaaucuaacuucaucau

SEQ ID NO: 544778 - RNA, 32 nt, Human
uuuauagcuguuccuccaaguaucaauuuuuc

SEQ ID NO: 544779 - RNA, 32 nt, Human
uuuauaggaaggcagggcaaacuuguaggagu

SEQ ID NO: 544780 - RNA, 32 nt, Human
uuuauaggauguggucccacaggccugucaca

SEQ ID NO: 544781 - RNA, 32 nt, Human
uuuauaggccuuucauccuggugcugacggau

SEQ ID NO: 544782 - RNA, 32 nt, Human
uuuauagggugagguaagagacagccucccaa

SEQ ID NO: 544783 - RNA, 32 nt, Human
uuuauaguauaugugaaauccuagaaaaguau

SEQ ID NO: 544784 - RNA, 32 nt, Human
uuuauagucacagauggcagaggaagaggcuc

SEQ ID NO: 544785 - RNA, 21 nt, Human
uuuauaguccaaagaaaccaa

SEQ ID NO: 544786 - RNA, 32 nt, Human
uuuauaguccaguguuuguuuucauugaagaa

SEQ ID NO: 544787 - RNA, 32 nt, Human
uuuauaguccuggccagacccugcugcucacu

SEQ ID NO: 544788 - RNA, 32 nt, Human
uuuauagucucagcuacuagggaggcugaggc

SEQ ID NO: 544789 - RNA, 23 nt, Human
uuuauagugucuuucacguguuu

SEQ ID NO: 544790 - RNA, 32 nt, Human
uuuauaguguuagaaaaccagccacauuacag

SEQ ID NO: 544791 - RNA, 32 nt, Human
uuuauaguuggcuguggggacuucugauuucu

SEQ ID NO: 544792 - RNA, 32 nt, Human
uuuauaguuguguuguauuacuuguuuaauaa

SEQ ID NO: 544793 - RNA, 32 nt, Human
uuuauaguuuuaagaggaagaaaacagaaacg

SEQ ID NO: 544794 - RNA, 32 nt, Human
uuuauauaaacauccacuucucuuucaaaaga

SEQ ID NO: 544795 - RNA, 32 nt, Human
uuuauauaaauagagaaauggaguuagccaua

SEQ ID NO: 544796 - RNA, 32 nt, Human
uuuauauaauuguucuccguucguugauauca

SEQ ID NO: 544797 - RNA, 32 nt, Human
uuuauauacaagugauaauacagauuuguaac

SEQ ID NO: 544798 - RNA, 32 nt, Human
uuuauauagaggacaaaacagcauuaaacuca

SEQ ID NO: 544799 - RNA, 32 nt, Human
uuuauaucagcaucuuggcuaucagcuggagc

SEQ ID NO: 544800 - RNA, 32 nt, Human
uuuauaucagguaacugaggcacacaaaggga

SEQ ID NO: 544801 - RNA, 32 nt, Human
uuuauaucaugggugaaagugaucauaacauu

SEQ ID NO: 544802 - RNA, 32 nt, Human
uuuauauccaaguucagacucaaaggcauuau

SEQ ID NO: 544803 - RNA, 32 nt, Human
uuuauauccacacauaaagaccagccugauua

SEQ ID NO: 544804 - RNA, 32 nt, Human
uuuauaucucugcccaggucucggugccugca

SEQ ID NO: 544805 - RNA, 32 nt, Human
uuuauaugaacucuguuucuuuccucgaaggc

SEQ ID NO: 544806 - RNA, 32 nt, Human
uuuauaugcagguuuuuguuguaccuguaucc

SEQ ID NO: 544807 - RNA, 32 nt, Human
uuuauaugcauauauuuuagggcugcuagacu

SEQ ID NO: 544808 - RNA, 32 nt, Human
uuuauaugccgcugcuuugaaagagaaccuag

SEQ ID NO: 544809 - RNA, 32 nt, Human
uuuauaugggcaacuuuaugcgaaauccaaau

SEQ ID NO: 544810 - RNA, 32 nt, Human
uuuauauguccuuccaaaaauguuguugugua

SEQ ID NO: 544811 - RNA, 32 nt, Human
uuuauauguguauguauuuuguaucaaggaca

SEQ ID NO: 544812 - RNA, 32 nt, Human
uuuauauguguaugugugugacaggaaaaucu

SEQ ID NO: 544813 - RNA, 32 nt, Human
uuuauauguguguguauguguacacacaugua

SEQ ID NO: 544814 - RNA, 30 nt, Human
uuuauauguuacuggcaguuggaaaugcag

SEQ ID NO: 544815 - RNA, 32 nt, Human
uuuauauuaaaaugaaguaugugcuuaaaguc

SEQ ID NO: 544816 - RNA, 24 nt, Human
uuuauauuacauaaagucuuuaua

SEQ ID NO: 544817 - RNA, 32 nt, Human
uuuauauuacugaacaaccaaaucuacccucc

SEQ ID NO: 544818 - RNA, 32 nt, Human
uuuauauuaucaaaugagagcuacucuguuac

SEQ ID NO: 544819 - RNA, 32 nt, Human
uuuauauucauguuuguggaaaaaucuugcaa

SEQ ID NO: 544820 - RNA, 32 nt, Human
uuuauauugaaagaaauaggccagcagagacu

SEQ ID NO: 544821 - RNA, 32 nt, Human
uuuauauugagacauauaauguguaaacuuag

SEQ ID NO: 544822 - RNA, 32 nt, Human
uuuauauuuccaucuucagcccuuaacccagg

SEQ ID NO: 544823 - RNA, 32 nt, Human
uuuauauuugcagccacugucagaugggcauc

SEQ ID NO: 544824 - RNA, 32 nt, Human
uuuauauuuggggcaucucuauagaaagugac

SEQ ID NO: 544825 - RNA, 32 nt, Human
uuuauauuuucgcucugucucccagguuggag

SEQ ID NO: 544826 - RNA, 32 nt, Human
uuuauauuuucugugcaucacacacaugcuuu

SEQ ID NO: 544827 - RNA, 32 nt, Human
uuuauauuuuuaguagagauggaguuucacca

SEQ ID NO: 544828 - RNA, 32 nt, Human
uuuaucaaaacaagaugaaacacagaaaaguu

SEQ ID NO: 544829 - RNA, 32 nt, Human
uuuaucaaccuucaguguccaagcagaagacc

SEQ ID NO: 544830 - RNA, 32 nt, Human
uuuaucaagggccuacuuuauggcagacauug

SEQ ID NO: 544831 - RNA, 32 nt, Human
uuuaucaaguaguucaguauugucauuuguuu

SEQ ID NO: 544832 - RNA, 32 nt, Human
uuuaucaauacugaucagacuuuaaagaaauu

SEQ ID NO: 544833 - RNA, 32 nt, Human
uuuaucacaacaaaggccuaguuuguuccaug

SEQ ID NO: 544834 - RNA, 32 nt, Human
uuuaucacaugcuggcacuaaaaggcagaagg

SEQ ID NO: 544835 - RNA, 32 nt, Human
uuuaucaccuguucagaugagaagauuuuugu

SEQ ID NO: 544836 - RNA, 32 nt, Human
uuuaucaccuuucccauuucuuuccccacaag

SEQ ID NO: 544837 - RNA, 32 nt, Human
uuuaucaccuuuccucacauagguaccuuuuu

SEQ ID NO: 544838 - RNA, 32 nt, Human
uuuaucacgguaaacuucauucauagauccuc

SEQ ID NO: 544839 - RNA, 32 nt, Human
uuuaucacuacaagcuuuuaacuuuuuaaguu

SEQ ID NO: 544840 - RNA, 32 nt, Human
uuuaucagcaccugaggcaggagaagagauga

SEQ ID NO: 544841 - RNA, 32 nt, Human
uuuaucaggaugaccauugccauuugucaggu

SEQ ID NO: 544842 - RNA, 32 nt, Human
uuuaucaggcagccagagccugggagguggua

SEQ ID NO: 544843 - RNA, 32 nt, Human
uuuaucagguguaaacaaaaagcugaacaguu

SEQ ID NO: 544844 - RNA, 32 nt, Human
uuuaucagugccugggaaugcucaaggcccag

SEQ ID NO: 544845 - RNA, 31 nt, Human
uuuaucauaaauuuuuagcauuuaaaaauuc

SEQ ID NO: 544846 - RNA, 32 nt, Human
uuuaucauccuuuccccuuucccuucaacucu

SEQ ID NO: 544847 - RNA, 32 nt, Human
uuuaucaucgcuccaacuuucacuaaaaagga

SEQ ID NO: 544848 - RNA, 32 nt, Human
uuuaucaucugucaauccaucuuccuacuauc

SEQ ID NO: 544849 - RNA, 32 nt, Human
uuuaucaugaaugacuucuccauugugauucu

SEQ ID NO: 544850 - RNA, 32 nt, Human
uuuauccaaacaucuuccaauuuauuuuguuu

SEQ ID NO: 544851 - RNA, 32 nt, Human
uuuauccaaagcuuuuucucuguguccacucu

SEQ ID NO: 544852 - RNA, 32 nt, Human
uuuauccaacccauuuaaaccaaaaauaaaac

SEQ ID NO: 544853 - RNA, 32 nt, Human
uuuauccaccuacucaggccaguuucaugcag

SEQ ID NO: 544854 - RNA, 32 nt, Human
uuuauccagccugcuucuccagccuucuaggc

SEQ ID NO: 544855 - RNA, 32 nt, Human
uuuauccagucuaucauagaugggcauuuggg

SEQ ID NO: 544856 - RNA, 32 nt, Human
uuuauccauauugucucaaaugaccagauuuc

SEQ ID NO: 544857 - RNA, 32 nt, Human
uuuaucccagcacccugggggaugccagccuu

SEQ ID NO: 544858 - RNA, 32 nt, Human
uuuaucccagcagcagcgucuccuucaugagu

SEQ ID NO: 544859 - RNA, 32 nt, Human
uuuaucccaugagcaagaaccacuuuauagcu

SEQ ID NO: 544860 - RNA, 32 nt, Human
uuuaucccuuucucuucugacugguauaccua

SEQ ID NO: 544861 - RNA, 32 nt, Human
uuuauccgggugggaagagggagucacaucgc

SEQ ID NO: 544862 - RNA, 32 nt, Human
uuuauccugaacagccacagugccugaauuca

SEQ ID NO: 544863 - RNA, 32 nt, Human
uuuauccugaguacugggauuacaggcgccca

SEQ ID NO: 544864 - RNA, 32 nt, Human
uuuauccugauagccacugacccacucaagaa

SEQ ID NO: 544865 - RNA, 32 nt, Human
uuuauccugcagacccugcugcucugaaagaa

SEQ ID NO: 544866 - RNA, 32 nt, Human
uuuauccugcauugaaaaugcauuacuuuugc

SEQ ID NO: 544867 - RNA, 32 nt, Human
uuuauccugcuaacuuucauuuucuuauagca

SEQ ID NO: 544868 - RNA, 32 nt, Human
uuuauccuuccaccaucucucucagaggaaug

SEQ ID NO: 544869 - RNA, 32 nt, Human
uuuauccuuccaucuuuuccuuggcauuuacc

SEQ ID NO: 544870 - RNA, 32 nt, Human
uuuauccuugaauuugagggugaugggguggg

SEQ ID NO: 544871 - RNA, 32 nt, Human
uuuauccuuuguaucugaaauaccuuuaauuu

SEQ ID NO: 544872 - RNA, 32 nt, Human
uuuaucgccagagucccugaacucucgcuuuc

SEQ ID NO: 544873 - RNA, 32 nt, Human
uuuaucggcauuguccaaaauauuuuauucuu

SEQ ID NO: 544874 - RNA, 32 nt, Human
uuuaucgguggacccaacaaucuucuguagac

SEQ ID NO: 544875 - RNA, 23 nt, Human
uuuaucgucucgguuuuagccaa

SEQ ID NO: 544876 - RNA, 32 nt, Human
uuuaucuaaaccauugcuuaaugaguguguuu

SEQ ID NO: 544877 - RNA, 32 nt, Human
uuuaucuaccaagagcgcagacuugcauccug

SEQ ID NO: 544878 - RNA, 32 nt, Human
uuuaucuauuugcacguucccuagagaaacag

SEQ ID NO: 544879 - RNA, 32 nt, Human
uuuaucucccuuuaaaacccuaccuauccuga

SEQ ID NO: 544880 - RNA, 32 nt, Human
uuuaucucuccuuucauccuuuuuaucuuucu

SEQ ID NO: 544881 - RNA, 32 nt, Human
uuuaucucuugauguaaccaucuucuuucucc

SEQ ID NO: 544882 - RNA, 32 nt, Human
uuuaucugagaaggaaggaaggucagaaagug

SEQ ID NO: 544883 - RNA, 32 nt, Human
uuuaucugagcccacagguggaaaggggaacu

SEQ ID NO: 544884 - RNA, 32 nt, Human
uuuaucugcaccuuauagacugaugucucuuu

SEQ ID NO: 544885 - RNA, 32 nt, Human
uuuaucugcagauggccuaauacuuaguuguc

SEQ ID NO: 544886 - RNA, 32 nt, Human
uuuaucugcaucagccagguugcugaguucaa

SEQ ID NO: 544887 - RNA, 32 nt, Human
uuuaucuggacaucccaccaucaaagaucuug

SEQ ID NO: 544888 - RNA, 32 nt, Human
uuuaucuggcauuucuggcucucuaguuggcu

SEQ ID NO: 544889 - RNA, 32 nt, Human
uuuaucuggccucugcuaugagucacagcuga

SEQ ID NO: 544890 - RNA, 32 nt, Human
uuuaucuguauacauuucaccaauuuauuaac

SEQ ID NO: 544891 - RNA, 32 nt, Human
uuuaucuguggaaaauuuaaugcugaauuaca

SEQ ID NO: 544892 - RNA, 32 nt, Human
uuuaucuguuguccccuuccucuccucugccc

SEQ ID NO: 544893 - RNA, 32 nt, Human
uuuaucuuaaaagagcuugcucugucuaccuu

SEQ ID NO: 544894 - RNA, 32 nt, Human
uuuaucuuacuuuuggauaauauccacugcaa

SEQ ID NO: 544895 - RNA, 32 nt, Human
uuuaucuuauaagaggaaaacaugacaaucau

SEQ ID NO: 544896 - RNA, 32 nt, Human
uuuaucuuauuuucucaaucuccucucucuuu

SEQ ID NO: 544897 - RNA, 32 nt, Human
uuuaucuucacaagucuguaaucccagcacuu

SEQ ID NO: 544898 - RNA, 32 nt, Human
uuuaucuucccugagugccugggucucccucc

SEQ ID NO: 544899 - RNA, 32 nt, Human
uuuaucuuccuguguucucuggcuucagaguu

SEQ ID NO: 544900 - RNA, 32 nt, Human
uuuaucuuccuuauaaaucacacaccuuuucu

SEQ ID NO: 544901 - RNA, 32 nt, Human
uuuaucuucuccaucugugccucucuccuccc

SEQ ID NO: 544902 - RNA, 32 nt, Human
uuuaucuucugcucuuucuucuuccacacaug

SEQ ID NO: 544903 - RNA, 32 nt, Human
uuuaucuucuggaugccaaugugaauuguggu

SEQ ID NO: 544904 - RNA, 26 nt, Human
uuucuuggaugggaccuaucggguca

SEQ ID NO: 544905 - RNA, 31 nt, Human
uuucuuggcaaaguuucugguauggucaagc

SEQ ID NO: 544906 - RNA, 20 nt, Human
uuucuuggcaccuucagguc

SEQ ID NO: 544907 - RNA, 32 nt, Human
uuucuuggcaugcaucuuuaauuccuuauccu

SEQ ID NO: 544908 - RNA, 32 nt, Human
uuucuuggccccugucucucuccauguugggg

SEQ ID NO: 544909 - RNA, 32 nt, Human
uuucuuggccuguccucugcauggcccagugu

SEQ ID NO: 544910 - RNA, 32 nt, Human
uuucuuggccuucucuucucuggacuagguga

SEQ ID NO: 544911 - RNA, 32 nt, Human
uuucuuggcuuccuccuuacucccaucuggac

SEQ ID NO: 544912 - RNA, 32 nt, Human
uuucuugggaaaacauacuuuucauaucucuu

SEQ ID NO: 544913 - RNA, 32 nt, Human
uuucuugggaagucauugcuguucaucacuuu

SEQ ID NO: 544914 - RNA, 32 nt, Human
uuucuugggaggcugaggcgggaguaucauuu

SEQ ID NO: 544915 - RNA, 32 nt, Human
uuucuuggggccugaaccccagugguccaaag

SEQ ID NO: 544916 - RNA, 32 nt, Human
uuucuuggguguugagaacuuguaccauggac

SEQ ID NO: 544917 - RNA, 32 nt, Human
uuucuugguguuuguugucuccagguguaagc

SEQ ID NO: 544918 - RNA, 32 nt, Human
uuucuuguacaacugguacacacuaauaaaca

SEQ ID NO: 544919 - RNA, 32 nt, Human
uuucuugugcaucuguccaccuguuccccagu

SEQ ID NO: 544920 - RNA, 32 nt, Human
uuucuugugguguccggaucagcauccugcau

SEQ ID NO: 544921 - RNA, 32 nt, Human
uuucuugugugugccaucuuuccauuguuggc

SEQ ID NO: 544922 - RNA, 32 nt, Human
uuucuuguguuuuaagaauuaggagacaugga

SEQ ID NO: 544923 - RNA, 32 nt, Human
uuucuuguuguucaaaugauuuuaauuauugg

SEQ ID NO: 544924 - RNA, 32 nt, Human
uuucuuguuuuauucccuugaugaccuaggga

SEQ ID NO: 544925 - RNA, 32 nt, Human
uuucuuguuuuuagaauuauuccuggacuauu

SEQ ID NO: 544926 - RNA, 32 nt, Human
uuucuuuaaucaauguguucucuucggugaua

SEQ ID NO: 544927 - RNA, 32 nt, Human
uuucuuuaauguagccaauuuaggcaggguaa

SEQ ID NO: 544928 - RNA, 24 nt, Human
uuucuuuagagagcagaagcagaa

SEQ ID NO: 544929 - RNA, 32 nt, Human
uuucuuuagggcccuggacucaaaagagcauc

SEQ ID NO: 544930 - RNA, 32 nt, Human
uuucuuuauaauucacacauauaugcagagaa

SEQ ID NO: 544931 - RNA, 32 nt, Human
uuucuuuauagucugaacuguuuaauaaauug

SEQ ID NO: 544932 - RNA, 23 nt, Human
uuucuuuauauccaguuuuuaca

SEQ ID NO: 544933 - RNA, 32 nt, Human
uuucuuuaucaauuaaauagcucagagaguac

SEQ ID NO: 544934 - RNA, 32 nt, Human
uuucuuuaugaucuuaacuucacuuccauuag

SEQ ID NO: 544935 - RNA, 32 nt, Human
uuucuuuauggcaaagccaaaauagcuccuac

SEQ ID NO: 544936 - RNA, 22 nt, Human
uuucuuuauguacaagauggaa

SEQ ID NO: 544937 - RNA, 32 nt, Human
uuucuuuauguagaaaauggguuccugcagca

SEQ ID NO: 544938 - RNA, 32 nt, Human
uuucuuuauuuauaacaugaagcacaauggau

SEQ ID NO: 544939 - RNA, 32 nt, Human
uuucuuucacuacuuauccugccuuuuugcau

SEQ ID NO: 544940 - RNA, 32 nt, Human
uuucuuucacuccuuccuuuccuuccuuucuc

SEQ ID NO: 544941 - RNA, 32 nt, Human
uuucuuucagcagccugagucagaggcgggcu

SEQ ID NO: 544942 - RNA, 32 nt, Human
uuucuuucagccacaguguguaacacucagca

SEQ ID NO: 544943 - RNA, 32 nt, Human
uuucuuucagcuguuuguuaguuuuugcuuua

SEQ ID NO: 544944 - RNA, 32 nt, Human
uuucuuucaguguggcugcuuuggcuugguga

SEQ ID NO: 544945 - RNA, 32 nt, Human
uuucuuucaguuaaaccuguguccacauguuu

SEQ ID NO: 544946 - RNA, 32 nt, Human
uuucuuucaucugccuuucauccugcaaaaag

SEQ ID NO: 544947 - RNA, 32 nt, Human
uuucuuucauucuugcugguuuauaccuaugu

SEQ ID NO: 544948 - RNA, 32 nt, Human
uuucuuucauuucacagucuaauucucccaga

SEQ ID NO: 544949 - RNA, 32 nt, Human
uuucuuucauuuccucggauucuuucaccacu

SEQ ID NO: 544950 - RNA, 32 nt, Human
uuucuuucccccaaaugucugugcagugucag

SEQ ID NO: 544951 - RNA, 32 nt, Human
uuucuuucccccauucucccugcauccuuguc

SEQ ID NO: 544952 - RNA, 32 nt, Human
uuucuuuccccucaucuuucaccaggaacugg

SEQ ID NO: 544953 - RNA, 32 nt, Human
uuucuuucccucuccguuuuggugggcugguu

SEQ ID NO: 544954 - RNA, 32 nt, Human
uuucuuucccuuaagaaucaaaagcagaaaac

SEQ ID NO: 544955 - RNA, 32 nt, Human
uuucuuucccuuucucuuucuaucucucuuua

SEQ ID NO: 544956 - RNA, 32 nt, Human
uuucuuuccuucccucuccagagauguugguu

SEQ ID NO: 544957 - RNA, 32 nt, Human
uuucuuuccuuuccccuucccuucccuucccu

SEQ ID NO: 544958 - RNA, 32 nt, Human
uuucuuuccuuuucucuucuuuauuuucuuuu

SEQ ID NO: 544959 - RNA, 32 nt, Human
uuucuuucuaacuccuaccuuucccuugcaga

SEQ ID NO: 544960 - RNA, 32 nt, Human
uuucuuucuauaacguccuccuuguccuccuu

SEQ ID NO: 544961 - RNA, 32 nt, Human
uuucuuucucacuguaaauacacauucuuauu

SEQ ID NO: 544962 - RNA, 32 nt, Human
uuucuuucuccaggaggguggugauagaaaca

SEQ ID NO: 544963 - RNA, 32 nt, Human
uuucuuucuccuccaugugucuuggcaggcac

SEQ ID NO: 544964 - RNA, 32 nt, Human
uuucuuucuccuccuccaaccuuggcggaggc

SEQ ID NO: 544965 - RNA, 32 nt, Human
uuucuuucuuacagaaguucugauauugaauu

SEQ ID NO: 544966 - RNA, 32 nt, Human
uuucuuucuuccuauggucuugucugaauaaa

SEQ ID NO: 544967 - RNA, 32 nt, Human
uuucuuucuuucagccugaauucuaagcaaca

SEQ ID NO: 544968 - RNA, 32 nt, Human
uuucuuucuuucuccuuccuuccuuccucuuu

SEQ ID NO: 544969 - RNA, 32 nt, Human
uuucuuucuuugacuccucuucugccugccuu

SEQ ID NO: 544970 - RNA, 32 nt, Human
uuucuuugagaaagaaguggacuggggcacaa

SEQ ID NO: 544971 - RNA, 23 nt, Human
uuucuuugauauacaguuuuuuc

SEQ ID NO: 544972 - RNA, 32 nt, Human
uuucuuugaucuggacagaacauuuauaucag

SEQ ID NO: 544973 - RNA, 32 nt, Human
uuucuuugccaucucugcuccaaccgggaugg

SEQ ID NO: 544974 - RNA, 31 nt, Human
uuucuuugccucucuaugucucucugucuuu

SEQ ID NO: 544975 - RNA, 23 nt, Human
uuucuuuggaaaccaggauggaa

SEQ ID NO: 544976 - RNA, 23 nt, Human
uuucuuugguuuuguuuucuuca

SEQ ID NO: 544977 - RNA, 32 nt, Human
uuucuuuguaaauacuaugcguucuggugugu

SEQ ID NO: 544978 - RNA, 32 nt, Human
uuucuuuguaaauacuauguguucuggugugu

SEQ ID NO: 544979 - RNA, 19 nt, Human
uuucuuuguauucuaaaaa

SEQ ID NO: 544980 - RNA, 32 nt, Human
uuucuuugucuuucuuucuuuuccuuccuccc

SEQ ID NO: 544981 - RNA, 26 nt, Human
uuucuuuguguucucucauuuuuuca

SEQ ID NO: 544982 - RNA, 32 nt, Human
uuucuuuguucccagccaugcuuuuguaacuu

SEQ ID NO: 544983 - RNA, 32 nt, Human
uuucuuuguugacugaaaaagcgagaaaggug

SEQ ID NO: 544984 - RNA, 32 nt, Human
uuucuuuuacuuaccugcuugaauacuugaau

SEQ ID NO: 544985 - RNA, 32 nt, Human
uuucuuuuaucaguccguugggcacagcaggu

SEQ ID NO: 544986 - RNA, 32 nt, Human
uuucuuuuauucaccuucccuugaccaagaaa

SEQ ID NO: 544987 - RNA, 32 nt, Human
uuucuuuucaguuuguguuauuuggaagacag

SEQ ID NO: 544988 - RNA, 32 nt, Human
uuucuuuucauaaagauacauaccuggauuug

SEQ ID NO: 544989 - RNA, 32 nt, Human
uuucuuuucauugccuccuuuuccaggcagcu

SEQ ID NO: 544990 - RNA, 32 nt, Human
uuucuuuuccuuccucccuuccuuccuuccuu

SEQ ID NO: 544991 - RNA, 32 nt, Human
uuucuuuucuacugcaucaucaggcugcagau

SEQ ID NO: 544992 - RNA, 32 nt, Human
uuucuuuucuaucacauuuucagucuguaaau

SEQ ID NO: 544993 - RNA, 32 nt, Human
uuucuuuucuauuccaucaucugcccuuuuau

SEQ ID NO: 544994 - RNA, 32 nt, Human
uuucuuuucucaucuuaaaacccuuuauguuc

SEQ ID NO: 544995 - RNA, 32 nt, Human
uuucuuuucucuauccucuuucccagcuuuau

SEQ ID NO: 544996 - RNA, 32 nt, Human
uuucuuuucuggacucuaauaggcccaauuaa

SEQ ID NO: 544997 - RNA, 32 nt, Human
uuucuuuucuggcacuuuaauggcuugaggua

SEQ ID NO: 544998 - RNA, 32 nt, Human
uuucuuuucuucuccucugggauggguagucu

SEQ ID NO: 544999 - RNA, 32 nt, Human
uuucuuuucuugguggugcaaagugguauaac

SEQ ID NO: 545000 - RNA, 32 nt, Human
uuucuuuucuuugcccuccugauucuuggcug

SEQ ID NO: 545001 - RNA, 32 nt, Human
uuucuuuucuuuucuuucuuccuuccuuuuuc

SEQ ID NO: 545002 - RNA, 32 nt, Human
uuucuuuucuuuuucaagauggagucucaaua

SEQ ID NO: 545003 - RNA, 32 nt, Human
uuucuuuugaaggaauaaauguucuuuauaca

SEQ ID NO: 545004 - RNA, 32 nt, Human
uuucuuuugagacccuuugcuccaguccuaug

SEQ ID NO: 545005 - RNA, 32 nt, Human
uuucuuuugcauguugccuagcauuuuauaga

SEQ ID NO: 545006 - RNA, 18 nt, Human
uuucuuuugcucugcuuu

SEQ ID NO: 545007 - RNA, 32 nt, Human
uuucuuuugcuucuggcuucugagaguuuccu

SEQ ID NO: 545008 - RNA, 32 nt, Human
uuucuuuuggcuuaaagugaaaaagaagaaau

SEQ ID NO: 545009 - RNA, 32 nt, Human
uuucuuuugggaagagggagaaaaugaaauaa

SEQ ID NO: 545010 - RNA, 32 nt, Human
uuucuuuuguuagaggagagcuugaugugauu

SEQ ID NO: 545011 - RNA, 32 nt, Human
uuucuuuuuaaaaauuuuccaaaacuuuucuc

SEQ ID NO: 545012 - RNA, 25 nt, Human
uuucuuuuuaguucucuagggucug

SEQ ID NO: 545013 - RNA, 32 nt, Human
uuucuuuuuccaccugagacuuguuuauaaaa

SEQ ID NO: 545014 - RNA, 32 nt, Human
uuucuuuuucccucacuccaucauccugacag

SEQ ID NO: 545015 - RNA, 32 nt, Human
uuucuuuuuccuccucugccccagguccaugc

SEQ ID NO: 545016 - RNA, 32 nt, Human
uuucuuuuucucccauccuuuuuccuucccaa

SEQ ID NO: 545017 - RNA, 32 nt, Human
uuucuuuuucuuccuuucuuuucuuuucuuuu

SEQ ID NO: 545018 - RNA, 32 nt, Human
uuucuuuuucuuucucuugcuguuuccuucuu

SEQ ID NO: 545019 - RNA, 32 nt, Human
uuucuuuuugacuuaguauccggcacacaaag

SEQ ID NO: 545020 - RNA, 32 nt, Human
uuucuuuuugacuuaguaucuggcacacaaag

SEQ ID NO: 545021 - RNA, 32 nt, Human
uuucuuuuugagacagagucucgcucuauugc

SEQ ID NO: 545022 - RNA, 32 nt, Human
uuucuuuuugagaccuagucucacucuguugc

SEQ ID NO: 545023 - RNA, 32 nt, Human
uuucuuuuugagacggaaucucacucuuucac

SEQ ID NO: 545024 - RNA, 32 nt, Human
uuucuuuuugagacggagucuuccucugucgc

SEQ ID NO: 545025 - RNA, 32 nt, Human
uuucuuuuugagacggaguuucgcuuuugucc

SEQ ID NO: 545026 - RNA, 32 nt, Human
uuucuuuuugagauggagucacacucuccagg

SEQ ID NO: 545027 - RNA, 32 nt, Human
uuucuuuuugagauggagucucgcucucuuga

SEQ ID NO: 545028 - RNA, 32 nt, Human
uuucuuuuugagauggagucucgcucugucgc

SEQ ID NO: 545029 - RNA, 32 nt, Human
uuucuuuuugagauggagucucgcucuguugc

SEQ ID NO: 545030 - RNA, 32 nt, Human
uuucuuuuugcccaggcuggagugcaguggcg

SEQ ID NO: 545031 - RNA, 23 nt, Human
uuucuuuuugucuuuuggguguu

SEQ ID NO: 545032 - RNA, 23 nt, Human
uuucuuuuuucuuuuagagcucg

SEQ ID NO: 545033 - RNA, 32 nt, Human
uuugaaaaaccagcugagcagaaugccauguu

SEQ ID NO: 545034 - RNA, 32 nt, Human
uuugaaaaauacacacgaauguccucaguauc

SEQ ID NO: 545035 - RNA, 32 nt, Human
uuugaaaaauaccauaauggcauuugagacug

SEQ ID NO: 545036 - RNA, 32 nt, Human
uuugaaaacauacacugagcugcuucugcgcu

SEQ ID NO: 545037 - RNA, 32 nt, Human
uuugaaaaccacugccccagacagcaauaugu

SEQ ID NO: 545038 - RNA, 32 nt, Human
uuugaaaaccugcagcauucccauugaagcca

SEQ ID NO: 545039 - RNA, 32 nt, Human
uuugaaaacugggccucccugcucugugauug

SEQ ID NO: 545040 - RNA, 32 nt, Human
uuugaaaagagaaaccuaauuggcuauuuaau

SEQ ID NO: 545041 - RNA, 32 nt, Human
uuugaaaagaggugugcaagagagggaugcau

SEQ ID NO: 545042 - RNA, 32 nt, Human
uuugaaaagauaagcaaaauuuauagacuauu

SEQ ID NO: 545043 - RNA, 32 nt, Human
uuugaaaagccagcucucccuggcagagaaag

SEQ ID NO: 545044 - RNA, 32 nt, Human
uuugaaaaggaaaucuagcaugugaggggacu

SEQ ID NO: 545045 - RNA, 32 nt, Human
uuugaaacagcuguuuuucccacauuugcugc

SEQ ID NO: 545046 - RNA, 32 nt, Human
uuugaaacauagugcuucuacuuguugaauga

SEQ ID NO: 545047 - RNA, 32 nt, Human
uuugaaacaugcggguuugaaauaugacaccu

SEQ ID NO: 545048 - RNA, 32 nt, Human
uuugaaaccaacagcagauguugcaaacuuuc

SEQ ID NO: 545049 - RNA, 32 nt, Human
uuugaaaccagcauggccaacagaugugagcc

SEQ ID NO: 545050 - RNA, 32 nt, Human
uuugaaaccagccuagguaacauagugagacc

SEQ ID NO: 545051 - RNA, 32 nt, Human
uuugaaaccagccuggacuacauggugaaacu

SEQ ID NO: 545052 - RNA, 32 nt, Human
uuugaaaccagccuggccaacauggcgaaacc

SEQ ID NO: 545053 - RNA, 32 nt, Human
uuugaaaccagccuggccaacauggugaaaac

SEQ ID NO: 545054 - RNA, 32 nt, Human
uuugaaaccagccuggccaacauggugaaacc

SEQ ID NO: 545055 - RNA, 32 nt, Human
uuugaaaccagccuggccaacauggugaaauu

SEQ ID NO: 545056 - RNA, 32 nt, Human
uuugaaaccagccugggcaacauggugaaacc

SEQ ID NO: 545057 - RNA, 32 nt, Human
uuugaaaccagccuggguaacauggcaaaauc

SEQ ID NO: 545058 - RNA, 32 nt, Human
uuugaaaccagcuguuucccaaacucugcuuc

SEQ ID NO: 545059 - RNA, 32 nt, Human
uuugaaaccaggaguucaggaccagccuggaa

SEQ ID NO: 545060 - RNA, 32 nt, Human
uuugaaaccuaccuaggcaacauggugaaacc

SEQ ID NO: 545061 - RNA, 32 nt, Human
uuugaaacuagccuggccaacguggcaaaacu

SEQ ID NO: 545062 - RNA, 32 nt, Human
uuugaaacuagucuggucaacauggugaaacc

SEQ ID NO: 545063 - RNA, 32 nt, Human
uuugaaacugaccuuuuucugcgaaguucacg

SEQ ID NO: 545064 - RNA, 32 nt, Human
uuugaaacugauuucuagaaaaagcugacucc

SEQ ID NO: 545065 - RNA, 32 nt, Human
uuugaaacuguacaaauacauggaugugaaau

SEQ ID NO: 545066 - RNA, 32 nt, Human
uuugaaagacuuuuguuuuucuugacuuaauu

SEQ ID NO: 545067 - RNA, 32 nt, Human
uuugaaagagaccaaaucaggcccagaccgcc

SEQ ID NO: 545068 - RNA, 32 nt, Human
uuugaaagaugugaguuggcaaguuccucaca

SEQ ID NO: 545069 - RNA, 32 nt, Human
uuugaaagcaggucauguucacugcgaugcug

SEQ ID NO: 545070 - RNA, 32 nt, Human
uuugaaagcuguuucuguuuucauuuuacauu

SEQ ID NO: 545071 - RNA, 32 nt, Human
uuugaaaggagaaggaauuggagcagcuuuuc

SEQ ID NO: 545072 - RNA, 32 nt, Human
uuugaaaggagagugaaggcagagaugguuac

SEQ ID NO: 545073 - RNA, 32 nt, Human
uuugaaaggaugacaguucuguuuguuagaug

SEQ ID NO: 545074 - RNA, 32 nt, Human
uuugaaaggcauugugggucugucuuuaaagu

SEQ ID NO: 545075 - RNA, 32 nt, Human
uuugaaaggcuguuugaaagaggaauguuuaa

SEQ ID NO: 545076 - RNA, 32 nt, Human
uuugaaaguaggaacucuuaagcaaugguaau

SEQ ID NO: 545077 - RNA, 32 nt, Human
uuugaaaguauagagcaguaacacaguaacag

SEQ ID NO: 545078 - RNA, 32 nt, Human
uuugaaaguauguuuacaacaaacugauacua

SEQ ID NO: 545079 - RNA, 32 nt, Human
uuugaaaguucuaaccucuucuugcccuuaag

SEQ ID NO: 545080 - RNA, 28 nt, Human
uuugaaauaaauguuuccuguugaaaug

SEQ ID NO: 545081 - RNA, 31 nt, Human
uuugaaauaaauguuuccuguugaaaugaaa

SEQ ID NO: 545082 - RNA, 32 nt, Human
uuugaaauagccaaucugaauuggcuuagagu

SEQ ID NO: 545083 - RNA, 32 nt, Human
uuugaaauauccagacuuguagggaagaaaac

SEQ ID NO: 545084 - RNA, 32 nt, Human
uuugaaaucucaggacucuucuggccguaggu

SEQ ID NO: 545085 - RNA, 32 nt, Human
uuugaaaugaggaaacuuugauaggaugugga

SEQ ID NO: 545086 - RNA, 32 nt, Human
uuugaaauggcaguggcaaauaaauaaauacu

SEQ ID NO: 545087 - RNA, 32 nt, Human
uuugaaauguagagugcuuccuccuaaccauu

SEQ ID NO: 545088 - RNA, 32 nt, Human
uuugaaauuaucacccauauaaaagagggaca

SEQ ID NO: 545089 - RNA, 32 nt, Human
uuugaaauugauaccauuuucuacucacaaug

SEQ ID NO: 545090 - RNA, 32 nt, Human
uuugaaauuucgagguaaucuacuuuggagac

SEQ ID NO: 545091 - RNA, 32 nt, Human
uuugaaauuugcaaaugcuucccugcugucag

SEQ ID NO: 545092 - RNA, 32 nt, Human
uuugaacacguaaacaacacagacuucaagca

SEQ ID NO: 545093 - RNA, 32 nt, Human
uuugaacaucacuaaacaagcaaauggaauga

SEQ ID NO: 545094 - RNA, 32 nt, Human
uuugaacauuuucugaacuaaaaaccucuauu

SEQ ID NO: 545095 - RNA, 32 nt, Human
uuugaaccaaagcucaaaacaaucaagacccu

SEQ ID NO: 545096 - RNA, 32 nt, Human
uuugaaccaggauggcugagccccgccaggag

SEQ ID NO: 545097 - RNA, 32 nt, Human
uuugaaccagggaggcagagauugcagugagc

SEQ ID NO: 545098 - RNA, 32 nt, Human
uuugaaccaugagggcccucugcccaggugau

SEQ ID NO: 545099 - RNA, 32 nt, Human
uuugaacccaggacacggagauugcagugagc

SEQ ID NO: 545100 - RNA, 32 nt, Human
uuugaacccaggaggcacagguugcagugagc

SEQ ID NO: 545101 - RNA, 32 nt, Human
uuugaacccaggaggcagagguugcagcgagc

SEQ ID NO: 545102 - RNA, 32 nt, Human
uuugaacccaggaggcagagguugcagugagc

SEQ ID NO: 545103 - RNA, 32 nt, Human
uuugaacccaggaggcggagguugcagugacc

SEQ ID NO: 545104 - RNA, 32 nt, Human
uuugaacccaggaggcugagguugcagugagc

SEQ ID NO: 545105 - RNA, 32 nt, Human
uuugaacccaggagguggacauuacagugagc

SEQ ID NO: 545106 - RNA, 32 nt, Human
uuugaacccaggagguggaggcugcagugagc

SEQ ID NO: 545107 - RNA, 32 nt, Human
uuugaacccaggucuaccuguugcagagucaa

SEQ ID NO: 545108 - RNA, 32 nt, Human
uuugaaccccggagauggagguugcagugagc

SEQ ID NO: 545109 - RNA, 32 nt, Human
uuugaaccccggaggcagagguuucagugagc

SEQ ID NO: 545110 - RNA, 22 nt, Human
uuugaaccccuguaggcugcau

SEQ ID NO: 545111 - RNA, 32 nt, Human
uuugaacccgcccugcacugcugucugggcgg

SEQ ID NO: 545112 - RNA, 32 nt, Human
uuugaacccggcaggcggagguugcagugagc

SEQ ID NO: 545113 - RNA, 32 nt, Human
uuugaacccgggaagcggagguugcagggagc

SEQ ID NO: 545114 - RNA, 32 nt, Human
uuugaacccgggaggcagagguugcagugagc

SEQ ID NO: 545115 - RNA, 32 nt, Human
uuugaacccgggaggcagagguugcagugugg

SEQ ID NO: 545116 - RNA, 32 nt, Human
uuugaacccgggaggcagagguugugagcuga

SEQ ID NO: 545117 - RNA, 32 nt, Human
uuugaacccgggaggcggaggcugcagugagc

SEQ ID NO: 545118 - RNA, 32 nt, Human
uuugaacccgggaggcggagguugcagugagu

SEQ ID NO: 545119 - RNA, 32 nt, Human
uuugaacccggguggcagagguugcagugagc

SEQ ID NO: 545120 - RNA, 32 nt, Human
uuugaacccuggaggcagagguuguagugagu

SEQ ID NO: 545121 - RNA, 32 nt, Human
uuugaacccugggaugcucuaauuggcugguu

SEQ ID NO: 545122 - RNA, 32 nt, Human
uuugaaccuaggaggcagagguugcagugaac

SEQ ID NO: 545123 - RNA, 32 nt, Human
uuugaaccuaggccaucuccugaggccuuuuc

SEQ ID NO: 545124 - RNA, 32 nt, Human
uuugaaccuccaggauuccacggugcuguccc

SEQ ID NO: 545125 - RNA, 32 nt, Human
uuugaaccuggaaggcggagguugcagugagc

SEQ ID NO: 545126 - RNA, 32 nt, Human
uuugaaccugggaggcagagguugcagugagc

SEQ ID NO: 545127 - RNA, 32 nt, Human
uuugaaccugggaggcggaggcugcagugagc

SEQ ID NO: 545128 - RNA, 32 nt, Human
uuugaaccugggaggcggagguugcagugagc

SEQ ID NO: 545129 - RNA, 32 nt, Human
uuugaaccugggaggcggggguuguggugagc

SEQ ID NO: 545130 - RNA, 32 nt, Human
uuugaaccugggagggggagguugccgugagc

SEQ ID NO: 545131 - RNA, 32 nt, Human
uuugaaccugggagguggagguugcagugagc

SEQ ID NO: 545132 - RNA, 32 nt, Human
uuugaaccuuuccuuccugcuuucuuuccagc

SEQ ID NO: 545133 - RNA, 32 nt, Human
uuugaacgucagugucacuuacccacaaaguu

SEQ ID NO: 545134 - RNA, 32 nt, Human
uuugaacuauuuauuucugaaaggacauguua

SEQ ID NO: 545135 - RNA, 32 nt, Human
uuugaacucaggaggcagagguugcaaugagc

SEQ ID NO: 545136 - RNA, 32 nt, Human
uuugaacucauucauguugagagggugucaaa

SEQ ID NO: 545137 - RNA, 32 nt, Human
uuugaacucuuucaggugcuuguccugccuac

SEQ ID NO: 545138 - RNA, 32 nt, Human
uuugaacugucaaaugaaaagagcucuaggcg

SEQ ID NO: 545139 - RNA, 32 nt, Human
uuugaacuugagggagaugauuuuggguaccu

SEQ ID NO: 545140 - RNA, 32 nt, Human
uuugaagaaagagaaaccagguauucugcuac

SEQ ID NO: 545141 - RNA, 32 nt, Human
uuugaagaacuuguggcauuuguuaaagaauc

SEQ ID NO: 545142 - RNA, 32 nt, Human
uuugaagaaggcauccagaagcuguaucagug

SEQ ID NO: 545143 - RNA, 32 nt, Human
uuugaagacaagaaaagugcuagaauaaauaa

SEQ ID NO: 545144 - RNA, 32 nt, Human
uuugaagacagaaaucugcauuuagaaucaga

SEQ ID NO: 545145 - RNA, 32 nt, Human
uuugaagaccaggguaugggcacuuuugccuu

SEQ ID NO: 545146 - RNA, 32 nt, Human
uuugaagacuaugguacagauugcgacaacau

SEQ ID NO: 545147 - RNA, 32 nt, Human
uuugaagaggacacuugugaaaagcaugcaca

SEQ ID NO: 545148 - RNA, 32 nt, Human
uuugaagauaaauagcaacuuuaucaaaguga

SEQ ID NO: 545149 - RNA, 32 nt, Human
uuugaagaugugaguauauuuaucucaguuuc

SEQ ID NO: 545150 - RNA, 32 nt, Human
uuugaagauuaggaggagaaaaagaggagcuu

SEQ ID NO: 545151 - RNA, 32 nt, Human
uuugaagcaaaauacauguacacuucaaagag

SEQ ID NO: 545152 - RNA, 32 nt, Human
uuugaagcagcagguccaggucacuuuguaau

SEQ ID NO: 545153 - RNA, 32 nt, Human
uuugaagcagcucugccuucuuagggcuaccc

SEQ ID NO: 545154 - RNA, 32 nt, Human
uuugaagcagucuugcucuguuacccaggcug

SEQ ID NO: 545155 - RNA, 32 nt, Human
uuugaagcccccaggggugggguggacgcgug

SEQ ID NO: 545156 - RNA, 32 nt, Human
uuugaagccuuucuaagaaagaaaugggggug

SEQ ID NO: 545157 - RNA, 32 nt, Human
uuugaagcuacugcugccuccauuucugggaa

SEQ ID NO: 545158 - RNA, 32 nt, Human
uuugaagcucuuccuuuugcacauacggcuuu

SEQ ID NO: 545159 - RNA, 32 nt, Human
uuugaagcugggaggcagaguuuucagugagc

SEQ ID NO: 545160 - RNA, 32 nt, Human
uuugaagcuucaaacuuagugcugcugcagac

SEQ ID NO: 545161 - RNA, 32 nt, Human
uuugaagcuuuauccauguaucauguuccgug

SEQ ID NO: 545162 - RNA, 32 nt, Human
uuugaagcuuucuggaccuguggucuuagucc

SEQ ID NO: 545163 - RNA, 32 nt, Human
uuugaaggaaauauacugggcuucauucauuc

SEQ ID NO: 545164 - RNA, 32 nt, Human
uuugaagggaggacgggagcuggggagaggaa

SEQ ID NO: 545165 - RNA, 32 nt, Human
uuugaagguacuugugcacaucagaacacugg

SEQ ID NO: 545166 - RNA, 32 nt, Human
uuugaaggucucaagcagaaccucacaucuuc

SEQ ID NO: 545167 - RNA, 32 nt, Human
uuugaaguaauaacugccacaugugggaagua

SEQ ID NO: 545168 - RNA, 31 nt, Human
uuugaaguacaguggaaucuguugaaucaga

SEQ ID NO: 545169 - RNA, 32 nt, Human
uuugaagucacagugaggcggccacaccuggu

SEQ ID NO: 545170 - RNA, 32 nt, Human
uuugaagucaucuuagcuuuccacaggaggga

SEQ ID NO: 545171 - RNA, 32 nt, Human
uuugaagucuuccuccucugugucuucccaag

SEQ ID NO: 545172 - RNA, 32 nt, Human
uuugaaguggacuuugaaagucauggggguuu

SEQ ID NO: 545173 - RNA, 32 nt, Human
uuugaaguuuagagaauccugguauuucagug

SEQ ID NO: 545174 - RNA, 32 nt, Human
uuugaaguuuggagaagaaagggauuugguaa

SEQ ID NO: 545175 - RNA, 32 nt, Human
uuugaauaagcacagauucuggcauugaaagc

SEQ ID NO: 545176 - RNA, 32 nt, Human
uuugaauaaugguuuugguuaccugggaaggc

SEQ ID NO: 545177 - RNA, 32 nt, Human
uuugaauacuuguuucuuuagcacuuugaaga

SEQ ID NO: 545178 - RNA, 32 nt, Human
uuugaauauuaagcuaaaagguuuccacuauu

SEQ ID NO: 545179 - RNA, 32 nt, Human
uuugaaucaagggggcgguuucccccauauug

SEQ ID NO: 545180 - RNA, 32 nt, Human
uuugaaucacuccugaauacagaggcauauuc

SEQ ID NO: 545181 - RNA, 32 nt, Human
uuugaaucccuucacuuucuuccuuggacuua

SEQ ID NO: 545182 - RNA, 32 nt, Human
uuugaauccugccucuccgucugcuagggaua

SEQ ID NO: 545183 - RNA, 32 nt, Human
uuugaauccugccucugccauuuccuggcuau

SEQ ID NO: 545184 - RNA, 32 nt, Human
uuugaaucuaugcaauauugacuuuaauacca

SEQ ID NO: 545185 - RNA, 32 nt, Human
uuugaaucucagucuucagccugcacugauuu

SEQ ID NO: 545186 - RNA, 32 nt, Human
uuugaaucugcugccaguucuggcucaaaugu

SEQ ID NO: 545187 - RNA, 32 nt, Human
uuugaaucugggaagcggagguugcagugagc

SEQ ID NO: 545188 - RNA, 32 nt, Human
uuugaaucugggacugugccuggcucccugau

SEQ ID NO: 545189 - RNA, 32 nt, Human
uuugaaugaagcccuaaaguaccacuuuaugc

SEQ ID NO: 545190 - RNA, 32 nt, Human
uuugaaugacccacccuuccugauuuuaagua

SEQ ID NO: 545191 - RNA, 32 nt, Human
uuugaaugagguacugggggccaagguguugg

SEQ ID NO: 545192 - RNA, 32 nt, Human
uuugaauggaaagugaccugugagagauugaa

SEQ ID NO: 545193 - RNA, 32 nt, Human
uuugaauggagacaggguuucaacauguuggc

SEQ ID NO: 545194 - RNA, 32 nt, Human
uuugaauuaaggcuaugauauuaagauagaaa

SEQ ID NO: 545195 - RNA, 32 nt, Human
uuugaauuaguccguuuucacacugcuauaaa

SEQ ID NO: 545196 - RNA, 32 nt, Human
uuugaauucccccagaagaguuguuuucaaaa

SEQ ID NO: 545197 - RNA, 32 nt, Human
uuugaauucgcgaggcagagguugcagcgaac

SEQ ID NO: 545198 - RNA, 32 nt, Human
uuugaauuggaaagagaagagugaagauccaa

SEQ ID NO: 545199 - RNA, 32 nt, Human
uuugaauuuccucaucccuccaucucaauccc

SEQ ID NO: 545200 - RNA, 32 nt, Human
uuugacaaacacagccaaggggauauuuacug

SEQ ID NO: 545201 - RNA, 32 nt, Human
uuugacaacaccucaaacuuuucuaaccauaa

SEQ ID NO: 545202 - RNA, 22 nt, Human
uuugacaauguggagcagcaca

SEQ ID NO: 545203 - RNA, 32 nt, Human
uuugacacauaaggaaauacacucugaaagau

SEQ ID NO: 545204 - RNA, 32 nt, Human
uuugacaccagccugggcaacauagugagacc

SEQ ID NO: 545205 - RNA, 32 nt, Human
uuugacaccagccugggcaacaugguaagacc

SEQ ID NO: 545206 - RNA, 32 nt, Human
uuugacacccaggcuggagugcaguggugcca

SEQ ID NO: 545207 - RNA, 32 nt, Human
uuugacacugguucuggccuuuccugccuuuu

SEQ ID NO: 545208 - RNA, 32 nt, Human
uuugacagaggagaaaaauuagccaaggaaga

SEQ ID NO: 545209 - RNA, 32 nt, Human
uuugacagagucucagucugucacccaggcug

SEQ ID NO: 545210 - RNA, 32 nt, Human
uuugacagaguggcugaugucaaggagaacaa

SEQ ID NO: 545211 - RNA, 32 nt, Human
uuugacagaguguuggaugugucaugucauca

SEQ ID NO: 545212 - RNA, 24 nt, Human
uuugacagccuuauaugacaugaa

SEQ ID NO: 545213 - RNA, 32 nt, Human
uuugacagcuaccucuggacaucucaagggcu

SEQ ID NO: 545214 - RNA, 32 nt, Human
uuugacagcugccagucuuccugccccuuuca

SEQ ID NO: 545215 - RNA, 32 nt, Human
uuugacagcuggucccugccucgguugauugu

SEQ ID NO: 545216 - RNA, 32 nt, Human
uuugacaggaaggggcuucaguuguuccucca

SEQ ID NO: 545217 - RNA, 32 nt, Human
uuugacaggaggagaauaaggcugaaagccuc

SEQ ID NO: 545218 - RNA, 32 nt, Human
uuugacaggguccucaguacaucagacaccca

SEQ ID NO: 545219 - RNA, 32 nt, Human
uuugacagggucucacucugucacccaggcug

SEQ ID NO: 545220 - RNA, 32 nt, Human
uuugacagggucucacucuguugcccaagcug

SEQ ID NO: 545221 - RNA, 32 nt, Human
uuugacagucccuuuguacacacugcuaugca

SEQ ID NO: 545222 - RNA, 30 nt, Human
uuugacagucuccuagugcuccugguagug

SEQ ID NO: 545223 - RNA, 32 nt, Human
uuugacauaugucuguaccugggaaaccauca

SEQ ID NO: 545224 - RNA, 32 nt, Human
uuugacaucaaccugggcaacauggugaccuc

SEQ ID NO: 545225 - RNA, 32 nt, Human
uuugacaucuuucuguggcaaagcucuuagaa

SEQ ID NO: 545226 - RNA, 32 nt, Human
uuugacaugacaaagauauaggugcuuaguuu

SEQ ID NO: 545227 - RNA, 32 nt, Human
uuugacauggccuuagugaguccugccuuucc

SEQ ID NO: 545228 - RNA, 32 nt, Human
uuugacaugggggugccaggugccaucaucuc

SEQ ID NO: 545229 - RNA, 32 nt, Human
uuugacauguacaguauguuuucaugccguug

SEQ ID NO: 545230 - RNA, 32 nt, Human
uuugacauuggagaauuggagugcagucauaa

SEQ ID NO: 545231 - RNA, 32 nt, Human
uuugaccaaguauuccaagaggccccauggag

SEQ ID NO: 545232 - RNA, 32 nt, Human
uuugaccacagguauccucuucaucagagaga

SEQ ID NO: 545233 - RNA, 32 nt, Human
uuugaccacuaugcaaccuaagccaugguccc

SEQ ID NO: 545234 - RNA, 32 nt, Human
uuugaccacuugugacuggaguucaguggccc

SEQ ID NO: 545235 - RNA, 32 nt, Human
uuugaccagucugacuuggugcagcccaugcu

SEQ ID NO: 545236 - RNA, 32 nt, Human
uuugaccauguuggccaggauggucucgauau

SEQ ID NO: 545237 - RNA, 32 nt, Human
uuugacccaaaucagggauuuccccaguccac

SEQ ID NO: 545238 - RNA, 32 nt, Human
uuugacccaguuuggaauguaucugcaauugu

SEQ ID NO: 545239 - RNA, 32 nt, Human
uuugacccccaggcuggagugcaguggcacga

SEQ ID NO: 545240 - RNA, 32 nt, Human
uuugacccgcccccuucucgcucauaaugaca

SEQ ID NO: 545241 - RNA, 32 nt, Human
uuugaccggugcaggugugaccagagaccacc

SEQ ID NO: 545242 - RNA, 32 nt, Human
uuugaccguguuagccaggauggucuugaucu

SEQ ID NO: 545243 - RNA, 32 nt, Human
uuugaccuaauggagcuagaaauaugucugug

SEQ ID NO: 545244 - RNA, 32 nt, Human
uuugaccucuguccugggcuccugggccaggu

SEQ ID NO: 545245 - RNA, 32 nt, Human
uuugaccugaugaccucaucccagcccuugau

SEQ ID NO: 545246 - RNA, 32 nt, Human
uuugaccugccugucccccucccucuugucuu

SEQ ID NO: 545247 - RNA, 32 nt, Human
uuugaccuuagacugcacuccccuucuuuauu

SEQ ID NO: 545248 - RNA, 32 nt, Human
uuugaccuucuaaaauguuuuuauguuagcac

SEQ ID NO: 545249 - RNA, 32 nt, Human
uuugaccuugcccuuggcagugccccacaucc

SEQ ID NO: 545250 - RNA, 32 nt, Human
uuugacggagucuugcucgguucgcccaggcu

SEQ ID NO: 545251 - RNA, 32 nt, Human
uuugacguggguggccagcgcgaugaacgccg

SEQ ID NO: 545252 - RNA, 28 nt, Human
uuugacguucaauaaaacuguugaaucu

SEQ ID NO: 545253 - RNA, 32 nt, Human
uuugacuaagcacaauuagaugacaaguuuuu

SEQ ID NO: 545254 - RNA, 32 nt, Human
uuugacuaagggcagaauucucagaacaaaac

SEQ ID NO: 545255 - RNA, 32 nt, Human
uuugacuacucugcuuuuaauuuaauaccagu

SEQ ID NO: 545256 - RNA, 32 nt, Human
uuugacuauguuggccaggcuagucuugaacu

SEQ ID NO: 545257 - RNA, 32 nt, Human
uuugacuauugcugcucuucaccagaaccuca

SEQ ID NO: 545258 - RNA, 32 nt, Human
uuugacucacugcaaccuccgccuccuggguu

SEQ ID NO: 545259 - RNA, 32 nt, Human
uuugacucuaaagucaagagcuucauucccug

SEQ ID NO: 545260 - RNA, 32 nt, Human
uuugacucuggucugaaaagauaaaagaaugu

SEQ ID NO: 545261 - RNA, 32 nt, Human
uuugacucuuaaaagaaauucauuucugaaau

SEQ ID NO: 545262 - RNA, 32 nt, Human
uuugacucuuccagcacccauggaugugccag

SEQ ID NO: 545263 - RNA, 32 nt, Human
uuugacugacaauucauuuuacacucuauaua

SEQ ID NO: 545264 - RNA, 32 nt, Human
uuugacugacgcuguuuagucuuucuguacau

SEQ ID NO: 545265 - RNA, 21 nt, Human
uuugacugccaccauugcaac

SEQ ID NO: 545266 - RNA, 32 nt, Human
uuugacuguaauugcguuaaaucuuuugagaa

SEQ ID NO: 545267 - RNA, 32 nt, Human
uuugacuguaccauugacuguuauggaaguuc

SEQ ID NO: 545268 - RNA, 32 nt, Human
uuugacugucuccagaccucaggggagcuggg

SEQ ID NO: 545269 - RNA, 32 nt, Human
uuugacuguggaaggguguauuuugcuggaau

SEQ ID NO: 545270 - RNA, 32 nt, Human
uuugacuucagccauggaugaggagugggaug

SEQ ID NO: 545271 - RNA, 32 nt, Human
uuugacuugcccacagucauggucucuguaga

SEQ ID NO: 545272 - RNA, 32 nt, Human
uuugacuugggugggaaggagggcgguggauu

SEQ ID NO: 545273 - RNA, 32 nt, Human
uuugacuugugacauuuucaggauuuacaaag

SEQ ID NO: 545274 - RNA, 32 nt, Human
uuugacuuugggacggagucucgcuuugucgc

SEQ ID NO: 545275 - RNA, 24 nt, Human
uuugagaaaaaggaaaggccccuu

SEQ ID NO: 545276 - RNA, 32 nt, Human
uuugagaaaagccaggcuucagaguuccugcu

SEQ ID NO: 545277 - RNA, 32 nt, Human
uuugagaaaauuaggggaaaggggaaaauuaa

SEQ ID NO: 545278 - RNA, 32 nt, Human
uuugagaacagccuggccaacacggugaaacc

SEQ ID NO: 545279 - RNA, 32 nt, Human
uuugagaacagccuggccaacagacgggagcc

SEQ ID NO: 545280 - RNA, 32 nt, Human
uuugagaacagccuggccaacauagugaaacu

SEQ ID NO: 545281 - RNA, 24 nt, Human
uuugagaacagccuggccaacaug

SEQ ID NO: 545282 - RNA, 32 nt, Human
uuugagaacagccuggccaacauggugaaacc

SEQ ID NO: 545283 - RNA, 32 nt, Human
uuugagaacagccuggccaacauggugaaacu

SEQ ID NO: 545284 - RNA, 32 nt, Human
uuugagaacagccuggccaacgugaugaaacc

SEQ ID NO: 545285 - RNA, 22 nt, Human
uuugagaacagccugggcaaca

SEQ ID NO: 545286 - RNA, 24 nt, Human
uuugagaacagccugggcaacaug

SEQ ID NO: 545287 - RNA, 32 nt, Human
uuugagaacagcuggccaagauggugaaaccc

SEQ ID NO: 545288 - RNA, 32 nt, Human
uuugagaacccauguauggguugcagugagcc

SEQ ID NO: 545289 - RNA, 32 nt, Human
uuugagaaguuuuggagaucucagggaaggau

SEQ ID NO: 545290 - RNA, 32 nt, Human
uuugagacaaagccacacucugucuccuuguc

SEQ ID NO: 545291 - RNA, 24 nt, Human
uuugagacaagccugagcaacaua

SEQ ID NO: 545292 - RNA, 32 nt, Human
uuugagacaagccugggcaacauagugagacc

SEQ ID NO: 545293 - RNA, 24 nt, Human
uuugagacaagccugggcauuaua

SEQ ID NO: 545294 - RNA, 32 nt, Human
uuugagacacagagucucauacucugccaccc

SEQ ID NO: 545295 - RNA, 32 nt, Human
uuugagacagagcgucucucucuguuacccag

SEQ ID NO: 545296 - RNA, 32 nt, Human
uuugagacagauucucacucugucucccaggc

SEQ ID NO: 545297 - RNA, 32 nt, Human
uuugagacagggucucacuguugcccaggcug

SEQ ID NO: 545298 - RNA, 32 nt, Human
uuugagacagucuugcuaugucacucaggcug

SEQ ID NO: 545299 - RNA, 32 nt, Human
uuugagacagucuugcucugucacccaggcug

SEQ ID NO: 545300 - RNA, 32 nt, Human
uuugagacagucuugcucugucaucaggcugg

SEQ ID NO: 545301 - RNA, 32 nt, Human
uuugagacagucuugcuguauugcccaggcug

SEQ ID NO: 545302 - RNA, 32 nt, Human
uuugagaccaacaugggcaacauggugaaaca

SEQ ID NO: 545303 - RNA, 32 nt, Human
uuugagaccaaccuagucaacauggugaaacc

SEQ ID NO: 545304 - RNA, 32 nt, Human
uuugagaccaaccuggccaacacagugagacc

SEQ ID NO: 545305 - RNA, 32 nt, Human
uuugagaccaaccuggccaacauggugaaacc

SEQ ID NO: 545306 - RNA, 32 nt, Human
uuugagaccaaccuggccaacauguugaaacc

SEQ ID NO: 545307 - RNA, 24 nt, Human
uuugagaccaaccugggcaauaua

SEQ ID NO: 545308 - RNA, 32 nt, Human
uuugagaccaaccugguuaacauggugaaacc

SEQ ID NO: 545309 - RNA, 32 nt, Human
uuugagaccaacuuggccaacauggugaaacc

SEQ ID NO: 545310 - RNA, 32 nt, Human
uuugagaccacccuggccaacauggugaaacc

SEQ ID NO: 545311 - RNA, 24 nt, Human
uuugagaccacccugggcaacaua

SEQ ID NO: 545312 - RNA, 32 nt, Human
uuugagaccacccugggcaacauagcgagacu

SEQ ID NO: 545313 - RNA, 32 nt, Human
uuugagaccaccuggccaacauggugaaaccc

SEQ ID NO: 545314 - RNA, 32 nt, Human
uuugagaccacggugaaacccugucucuacua

SEQ ID NO: 545315 - RNA, 32 nt, Human
uuugagaccagacuggccaacacagcgagacc

SEQ ID NO: 545316 - RNA, 24 nt, Human
uuugagaccagacugggcaacaug

SEQ ID NO: 545317 - RNA, 32 nt, Human
uuugagaccagacugggcaacauggugagacu

SEQ ID NO: 545318 - RNA, 32 nt, Human
uuugagaccagcaugaccaacauggcgaaacc

SEQ ID NO: 545319 - RNA, 24 nt, Human
uuugagaccagcaugggcaacaua

SEQ ID NO: 545320 - RNA, 32 nt, Human
uuugagaccagccaggccaacauggugaaacu

SEQ ID NO: 545321 - RNA, 32 nt, Human
uuugagaccagccagggcaacaaagugauacc

SEQ ID NO: 545322 - RNA, 24 nt, Human
uuugagaccagccagggcaacaua

SEQ ID NO: 545323 - RNA, 32 nt, Human
uuugagaccagcccaggcaacauggugaaacc

SEQ ID NO: 545324 - RNA, 32 nt, Human
uuugagaccagcccggacaacauggcgaaacc

SEQ ID NO: 545325 - RNA, 32 nt, Human
uuugagaccagcccggccaacauggugaaacc

SEQ ID NO: 545326 - RNA, 32 nt, Human
uuugagaccagccgggccaacauggugcaacc

SEQ ID NO: 545327 - RNA, 32 nt, Human
uuugagaccagccuagacaacauggugaaacc

SEQ ID NO: 545328 - RNA, 32 nt, Human
uuugagaccagccuagccaacaugcugaaacu

SEQ ID NO: 545329 - RNA, 32 nt, Human
uuugagaccagccuagccaacauggugaaauc

SEQ ID NO: 545330 - RNA, 24 nt, Human
uuugagaccagccuaggcaacaca

SEQ ID NO: 545331 - RNA, 32 nt, Human
uuugagaccagccuaggcaacacagugaaacc

SEQ ID NO: 545332 - RNA, 24 nt, Human
uuugagaccagccuaggcaacaua

SEQ ID NO: 545333 - RNA, 32 nt, Human
uuugagaccagccuaggcaacauagcaagacc

SEQ ID NO: 545334 - RNA, 24 nt, Human
uuugagaccagccuaggcaacaug

SEQ ID NO: 545335 - RNA, 32 nt, Human
uuugagaccagccuaggcaacauugcaagacu

SEQ ID NO: 545336 - RNA, 24 nt, Human
uuugagaccagccuaggcagcaua

SEQ ID NO: 545337 - RNA, 32 nt, Human
uuugagaccagccuaggugacaaagugagacc

SEQ ID NO: 545338 - RNA, 32 nt, Human
uuugagaccagccuagucaacaugaggaaacc

SEQ ID NO: 545339 - RNA, 32 nt, Human
uuugagaccagccucaccaacauggagaaauc

SEQ ID NO: 545340 - RNA, 32 nt, Human
uuugagaccagccucaucaacacagugaaacu

SEQ ID NO: 545341 - RNA, 32 nt, Human
uuugagaccagccuccuggccaacauggugaa

SEQ ID NO: 545342 - RNA, 32 nt, Human
uuugagaccagccucgccaacauggugaaacc

SEQ ID NO: 545343 - RNA, 32 nt, Human
uuugagaccagccucgccaacauggugagacc

SEQ ID NO: 545344 - RNA, 32 nt, Human
uuugagaccagccucggcaacauggcaaaauc

SEQ ID NO: 545345 - RNA, 32 nt, Human
uuugagaccagccugacauggugaaaccccau

SEQ ID NO: 545346 - RNA, 32 nt, Human
uuugagaccagccugaccaaaauggugaaacc

SEQ ID NO: 545347 - RNA, 32 nt, Human
uuugagaccagccugaccaaacauggcgaaac

SEQ ID NO: 545348 - RNA, 32 nt, Human
uuugagaccagccugaccaacauagagaaacc

SEQ ID NO: 545349 - RNA, 32 nt, Human
uuugagaccagccugaccaacauaguuucacc

SEQ ID NO: 545350 - RNA, 32 nt, Human
uuugagaccagccugaccaacauggagaaacc

SEQ ID NO: 545351 - RNA, 32 nt, Human
uuugagaccagccugaccaacauggcaaaacc

SEQ ID NO: 545352 - RNA, 32 nt, Human
uuugagaccagccugaccaacauggugaaacc

SEQ ID NO: 545353 - RNA, 32 nt, Human
uuugagaccagccugaccaacauggugaaacu

SEQ ID NO: 545354 - RNA, 32 nt, Human
uuugagaccagccugaccaacauggugaaauc

SEQ ID NO: 545355 - RNA, 32 nt, Human
uuugagaccagccugaccaacauggugaaaug

SEQ ID NO: 545356 - RNA, 32 nt, Human
uuugagaccagccugaccaacguggagaaacc

SEQ ID NO: 545357 - RNA, 32 nt, Human
uuugagaccagccugaccaacguggugaaacc

SEQ ID NO: 545358 - RNA, 32 nt, Human
uuugagaccagccugaccaacguuaaguaacc

SEQ ID NO: 545359 - RNA, 32 nt, Human
uuugagaccagccugaccaagguggugaaacc

SEQ ID NO: 545360 - RNA, 32 nt, Human
uuugagaccagccugaccaucauggugaaacc

SEQ ID NO: 545361 - RNA, 32 nt, Human
uuugagaccagccugacuaacacagugaaacc

SEQ ID NO: 545362 - RNA, 32 nt, Human
uuugagaccagccugagcaacaaagcaagacc

SEQ ID NO: 545363 - RNA, 24 nt, Human
uuugagaccagccugagcaacaua

SEQ ID NO: 545364 - RNA, 32 nt, Human
uuugagaccagccugagcaacauagcaaaacc

SEQ ID NO: 545365 - RNA, 32 nt, Human
uuugagaccagccugagcaacauagcgagacc

SEQ ID NO: 545366 - RNA, 24 nt, Human
uuugagaccagccugagcaaugug

SEQ ID NO: 545367 - RNA, 32 nt, Human
uuugagaccagccugagcaauguggugaaacc

SEQ ID NO: 545368 - RNA, 32 nt, Human
uuugagaccagccugagugacauagugagacu

SEQ ID NO: 545369 - RNA, 32 nt, Human
uuugagaccagccugaucaacauggugaaacc

SEQ ID NO: 545370 - RNA, 32 nt, Human
uuugagaccagccugaucaacguggugaaacc

SEQ ID NO: 545371 - RNA, 32 nt, Human
uuugagaccagccugcccaacauggugaaacc

SEQ ID NO: 545372 - RNA, 32 nt, Human
uuugagaccagccuggacaacaaacaugcuga

SEQ ID NO: 545373 - RNA, 32 nt, Human
uuugagaccagccuggacaacacagugagacc

SEQ ID NO: 545374 - RNA, 24 nt, Human
uuugagaccagccuggacaacaua

SEQ ID NO: 545375 - RNA, 32 nt, Human
uuugagaccagccuggacaacauaaugagacc

SEQ ID NO: 545376 - RNA, 24 nt, Human
uuugagaccagccuggacaacaug

SEQ ID NO: 545377 - RNA, 32 nt, Human
uuugagaccagccuggacaacaugggaaaacc

SEQ ID NO: 545378 - RNA, 32 nt, Human
uuugagaccagccuggacaacauggugaaacc

SEQ ID NO: 545379 - RNA, 32 nt, Human
uuugagaccagccuggcaaacauggcaaaacu

SEQ ID NO: 545380 - RNA, 32 nt, Human
uuugagaccagccuggcaaacauggugaaacc

SEQ ID NO: 545381 - RNA, 23 nt, Human
uuugagaccagccuggcaacaca

SEQ ID NO: 545382 - RNA, 32 nt, Human
uuugagaccagccuggcaacacagcaagaccc

SEQ ID NO: 545383 - RNA, 23 nt, Human
uuugagaccagccuggcaacaua

SEQ ID NO: 545384 - RNA, 32 nt, Human
uuugagaccagccuggccaaauggugaaaccc

SEQ ID NO: 545385 - RNA, 32 nt, Human
uuugagaccagccuggccaacacaguaaaccc

SEQ ID NO: 545386 - RNA, 32 nt, Human
uuugagaccagccuggccaacacggcaaaacc

SEQ ID NO: 545387 - RNA, 32 nt, Human
uuugagaccagccuggccaacacggugaaacc

SEQ ID NO: 545388 - RNA, 32 nt, Human
uuugagaccagccuggccaacagacgggagcc

SEQ ID NO: 545389 - RNA, 32 nt, Human
uuugagaccagccuggccaacagggugaaacc

SEQ ID NO: 545390 - RNA, 24 nt, Human
uuugagaccagccuggccaacaua

SEQ ID NO: 545391 - RNA, 32 nt, Human
uuugagaccagccuggccaacauaauuaaaau

SEQ ID NO: 545392 - RNA, 32 nt, Human
uuugagaccagccuggccaacauagugaaacc

SEQ ID NO: 545393 - RNA, 32 nt, Human
uuugagaccagccuggccaacauauagugaaa

SEQ ID NO: 545394 - RNA, 24 nt, Human
uuugagaccagccuggccaacaug

SEQ ID NO: 545395 - RNA, 32 nt, Human
uuugagaccagccuggccaacaugaugaaacc

SEQ ID NO: 545396 - RNA, 32 nt, Human
uuugagaccagccuggccaacaugaugaaaug

SEQ ID NO: 545397 - RNA, 32 nt, Human
uuugagaccagccuggccaacaugccgaaacc

SEQ ID NO: 545398 - RNA, 32 nt, Human
uuugagaccagccuggccaacaugcugaaacc

SEQ ID NO: 545399 - RNA, 32 nt, Human
uuugagaccagccuggccaacauggagaaacc

SEQ ID NO: 545400 - RNA, 32 nt, Human
uuugagaccagccuggccaacauggcaaaaac

SEQ ID NO: 545401 - RNA, 32 nt, Human
uuugagaccagccuggccaacauggcaaaacc

SEQ ID NO: 545402 - RNA, 32 nt, Human
uuugagaccagccuggccaacauggcgaaacc

SEQ ID NO: 545403 - RNA, 32 nt, Human
uuugagaccagccuggccaacauggcgagacc

SEQ ID NO: 545404 - RNA, 32 nt, Human
uuugagaccagccuggccaacauggcggaacc

SEQ ID NO: 545405 - RNA, 32 nt, Human
uuugagaccagccuggccaacaugguaaaaca

SEQ ID NO: 545406 - RNA, 32 nt, Human
uuugagaccagccuggccaacaugguaaaacc

SEQ ID NO: 545407 - RNA, 32 nt, Human
uuugagaccagccuggccaacaugguaaaacg

SEQ ID NO: 545408 - RNA, 32 nt, Human
uuugagaccagccuggccaacaugguaaaauc

SEQ ID NO: 545409 - RNA, 32 nt, Human
uuugagaccagccuggccaacauggugaaaca

SEQ ID NO: 545410 - RNA, 32 nt, Human
uuugagaccagccuggccaacauggugaaacc

SEQ ID NO: 545411 - RNA, 32 nt, Human
uuugagaccagccuggccaacauggugaaauc

SEQ ID NO: 545412 - RNA, 32 nt, Human
uuugagaccagccuggccaacauggugaagcu

SEQ ID NO: 545413 - RNA, 32 nt, Human
uuugagaccagccuggccaacauggugagacc

SEQ ID NO: 545414 - RNA, 32 nt, Human
uuugagaccagccuggccaacauggugauauc

SEQ ID NO: 545415 - RNA, 32 nt, Human
uuugagaccagccuggccaacaugguggaacc

SEQ ID NO: 545416 - RNA, 32 nt, Human
uuugagaccagccuggccaaccaacaugguga

SEQ ID NO: 545417 - RNA, 32 nt, Human
uuugagaccagccuggccaacguagugaaacc

SEQ ID NO: 545418 - RNA, 24 nt, Human
uuugagaccagccuggccaacgug

SEQ ID NO: 545419 - RNA, 32 nt, Human
uuugagaccagccuggccaacguggcaaaacc

SEQ ID NO: 545420 - RNA, 32 nt, Human
uuugagaccagccuggccaacguggugaaacc

SEQ ID NO: 545421 - RNA, 32 nt, Human
uuugagaccagccuggccaagauggugaaacc

SEQ ID NO: 545422 - RNA, 24 nt, Human
uuugagaccagccuggccaauaug

SEQ ID NO: 545423 - RNA, 32 nt, Human
uuugagaccagccuggccaauauggcaaaacc

SEQ ID NO: 545424 - RNA, 32 nt, Human
uuugagaccagccuggccaauauggcgaaacc

SEQ ID NO: 545425 - RNA, 32 nt, Human
uuugagaccagccuggccaauauggugaaacc

SEQ ID NO: 545426 - RNA, 24 nt, Human
uuugagaccagccuggccaaugug

SEQ ID NO: 545427 - RNA, 32 nt, Human
uuugagaccagccuggccaauguggugaaacc

SEQ ID NO: 545428 - RNA, 32 nt, Human
uuugagaccagccuggccaccauggugagacc

SEQ ID NO: 545429 - RNA, 24 nt, Human
uuugagaccagccuggccagcaug

SEQ ID NO: 545430 - RNA, 32 nt, Human
uuugagaccagccuggccagcauggcgaaacc

SEQ ID NO: 545431 - RNA, 32 nt, Human
uuugagaccagccuggccagcauggugaaacc

SEQ ID NO: 545432 - RNA, 32 nt, Human
uuugagaccagccuggcccacauggugaaacc

SEQ ID NO: 545433 - RNA, 24 nt, Human
uuugagaccagccuggccgacaug

SEQ ID NO: 545434 - RNA, 32 nt, Human
uuugagaccagccuggccgacauggugaaacc

SEQ ID NO: 545435 - RNA, 32 nt, Human
uuugagaccagccuggcuaacauggugaaauc

SEQ ID NO: 545436 - RNA, 32 nt, Human
uuugagaccagccuggcugacaggguaaaacc

SEQ ID NO: 545437 - RNA, 32 nt, Human
uuugagaccagccuggcuugaaccugggaggc

SEQ ID NO: 545438 - RNA, 32 nt, Human
uuugagaccagccugggaaacaucugccucua

SEQ ID NO: 545439 - RNA, 24 nt, Human
uuugagaccagccugggcaaaaca

SEQ ID NO: 545440 - RNA, 32 nt, Human
uuugagaccagccugggcaaaacagugggacc

SEQ ID NO: 545441 - RNA, 22 nt, Human
uuugagaccagccugggcaaca

SEQ ID NO: 545442 - RNA, 32 nt, Human
uuugagaccagccugggcaacaaagugagacc

SEQ ID NO: 545443 - RNA, 23 nt, Human
uuugagaccagccugggcaacac

SEQ ID NO: 545444 - RNA, 24 nt, Human
uuugagaccagccugggcaacaca

SEQ ID NO: 545445 - RNA, 32 nt, Human
uuugagaccagccugggcaacacagggagacu

SEQ ID NO: 545446 - RNA, 32 nt, Human
uuugagaccagccugggcaacacggugaaacc

SEQ ID NO: 545447 - RNA, 32 nt, Human
uuugagaccagccugggcaacagagugagacu

SEQ ID NO: 545448 - RNA, 32 nt, Human
uuugagaccagccugggcaacaggguaagguc

SEQ ID NO: 545449 - RNA, 24 nt, Human
uuugagaccagccugggcaacaua

SEQ ID NO: 545450 - RNA, 32 nt, Human
uuugagaccagccugggcaacauagcaaaacc

SEQ ID NO: 545451 - RNA, 32 nt, Human
uuugagaccagccugggcaacauagcaagacc

SEQ ID NO: 545452 - RNA, 32 nt, Human
uuugagaccagccugggcaacauagcaagauc

SEQ ID NO: 545453 - RNA, 32 nt, Human
uuugagaccagccugggcaacauagcgagacc

SEQ ID NO: 545454 - RNA, 32 nt, Human
uuugagaccagccugggcaacauagggaggcc

SEQ ID NO: 545455 - RNA, 32 nt, Human
uuugagaccagccugggcaacauaguaagacc

SEQ ID NO: 545456 - RNA, 32 nt, Human
uuugagaccagccugggcaacauagugagacu

SEQ ID NO: 545457 - RNA, 32 nt, Human
uuugagaccagccugggcaacauagugagauc

SEQ ID NO: 545458 - RNA, 32 nt, Human
uuugagaccagccugggcaacauagugaggcc

SEQ ID NO: 545459 - RNA, 32 nt, Human
uuugagaccagccugggcaacauagugaguga

SEQ ID NO: 545460 - RNA, 32 nt, Human
uuugagaccagccugggcaacauagugauacc

SEQ ID NO: 545461 - RNA, 32 nt, Human
uuugagaccagccugggcaacaucaggagauc

SEQ ID NO: 545462 - RNA, 32 nt, Human
uuugagaccagccugggcaacaucaugagacg

SEQ ID NO: 545463 - RNA, 24 nt, Human
uuugagaccagccugggcaacaug

SEQ ID NO: 545464 - RNA, 32 nt, Human
uuugagaccagccugggcaacaugaugaaaac

SEQ ID NO: 545465 - RNA, 32 nt, Human
uuugagaccagccugggcaacauggagaaacc

SEQ ID NO: 545466 - RNA, 32 nt, Human
uuugagaccagccugggcaacauggagagacc

SEQ ID NO: 545467 - RNA, 32 nt, Human
uuugagaccagccugggcaacauggcaaaacc

SEQ ID NO: 545468 - RNA, 32 nt, Human
uuugagaccagccugggcaacauggcaaaauc

SEQ ID NO: 545469 - RNA, 32 nt, Human
uuugagaccagccugggcaacauggcaagacc

SEQ ID NO: 545470 - RNA, 32 nt, Human
uuugagaccagccugggcaacauggcacaauu

SEQ ID NO: 545471 - RNA, 32 nt, Human
uuugagaccagccugggcaacauggcgaggcc

SEQ ID NO: 545472 - RNA, 32 nt, Human
uuugagaccagccugggcaacauggcuaaacc

SEQ ID NO: 545473 - RNA, 32 nt, Human
uuugagaccagccugggcaacauggugaaacc

SEQ ID NO: 545474 - RNA, 24 nt, Human
uuugagaccagccugggcaacgua

SEQ ID NO: 545475 - RNA, 32 nt, Human
uuugagaccagccugggcaacguagucagacc

SEQ ID NO: 545476 - RNA, 24 nt, Human
uuugagaccagccugggcaauaua

SEQ ID NO: 545477 - RNA, 32 nt, Human
uuugagaccagccugggcaauauagcaagacc

SEQ ID NO: 545478 - RNA, 32 nt, Human
uuugagaccagccugggcaauauagcgagacu

SEQ ID NO: 545479 - RNA, 32 nt, Human
uuugagaccagccugggcaauauagugagacc

SEQ ID NO: 545480 - RNA, 32 nt, Human
uuugagaccagccugggcaauaucgugagacc

SEQ ID NO: 545481 - RNA, 32 nt, Human
uuugagaccagccugggcaauauggugagacu

SEQ ID NO: 545482 - RNA, 24 nt, Human
uuugagaccagccugggcaccaug

SEQ ID NO: 545483 - RNA, 32 nt, Human
uuugagaccagccugggcaccauggugaaacc

SEQ ID NO: 545484 - RNA, 24 nt, Human
uuugagaccagccugggcagcaua

SEQ ID NO: 545485 - RNA, 32 nt, Human
uuugagaccagccugggcagcauagcaagaca

SEQ ID NO: 545486 - RNA, 32 nt, Human
uuugagaccagccugggcgauauagugaggcc

SEQ ID NO: 545487 - RNA, 24 nt, Human
uuugagaccagccuggggaacaua

SEQ ID NO: 545488 - RNA, 24 nt, Human
uuugagaccagccuggguaacaua

SEQ ID NO: 545489 - RNA, 32 nt, Human
uuugagaccagccuggguaacauagcaagacu

SEQ ID NO: 545490 - RNA, 32 nt, Human
uuugagaccagccuggguaacauagugagacc

SEQ ID NO: 545491 - RNA, 24 nt, Human
uuugagaccagccuggguaacaug

SEQ ID NO: 545492 - RNA, 32 nt, Human
uuugagaccagccuggguaacauggggagauc

SEQ ID NO: 545493 - RNA, 24 nt, Human
uuugagaccagccuggguaauaug

SEQ ID NO: 545494 - RNA, 32 nt, Human
uuugagaccagccuggguaauauggcaaaacc

SEQ ID NO: 545495 - RNA, 32 nt, Human
uuugagaccagccugguaaaauagugagaccu

SEQ ID NO: 545496 - RNA, 24 nt, Human
uuugagaccagccuggucaacaug

SEQ ID NO: 545497 - RNA, 32 nt, Human
uuugagaccagccuggucaacauggcgaaacc

SEQ ID NO: 545498 - RNA, 32 nt, Human
uuugagaccagccuggucaacaugguaaaacc

SEQ ID NO: 545499 - RNA, 32 nt, Human
uuugagaccagccuggucaacauugcaaaacc

SEQ ID NO: 545500 - RNA, 24 nt, Human
uuugagaccagccugguuaacaug

SEQ ID NO: 545501 - RNA, 32 nt, Human
uuugagaccagccugugcaacaucaugaaaca

SEQ ID NO: 545502 - RNA, 32 nt, Human
uuugagaccagccuugacaacauggugaaacc

SEQ ID NO: 545503 - RNA, 32 nt, Human
uuugagaccagccuugccaacacagugaaacc

SEQ ID NO: 545504 - RNA, 24 nt, Human
uuugagaccagcgugggcaauaua

SEQ ID NO: 545505 - RNA, 23 nt, Human
uuugagaccagcugggcaacaug

SEQ ID NO: 545506 - RNA, 32 nt, Human
uuugagaccagcugggcaacauggugaaaccc

SEQ ID NO: 545507 - RNA, 23 nt, Human
uuugagaccagcugggcaauaua

SEQ ID NO: 545508 - RNA, 32 nt, Human
uuugagaccagcuuagccaacauaguaagacc

SEQ ID NO: 545509 - RNA, 32 nt, Human
uuugagaccagcuugaccaacauggagaaacc

SEQ ID NO: 545510 - RNA, 24 nt, Human
uuugagaccagcuuggccaacaug

SEQ ID NO: 545511 - RNA, 32 nt, Human
uuugagaccagcuuggccaacauggugaaacc

SEQ ID NO: 545512 - RNA, 32 nt, Human
uuugagaccagcuuggccaacauggugaaauc

SEQ ID NO: 545513 - RNA, 22 nt, Human
uuugagaccagcuugggcaaca

SEQ ID NO: 545514 - RNA, 24 nt, Human
uuugagaccagcuugggcaacaua

SEQ ID NO: 545515 - RNA, 32 nt, Human
uuugagaccagcuugggcaacauagcaagacc

SEQ ID NO: 545516 - RNA, 32 nt, Human
uuugagaccagcuugggcaacauagugaaccc

SEQ ID NO: 545517 - RNA, 32 nt, Human
uuugagaccagcuugggcaacauagugagacc

SEQ ID NO: 545518 - RNA, 24 nt, Human
uuugagaccagcuugggcaacaug

SEQ ID NO: 545519 - RNA, 32 nt, Human
uuugagaccagcuugggcaacauggcaaaacc

SEQ ID NO: 545520 - RNA, 32 nt, Human
uuugagaccagcuugggcaacauggugaaacu

SEQ ID NO: 545521 - RNA, 24 nt, Human
uuugagaccagcuuggguaacaua

SEQ ID NO: 545522 - RNA, 24 nt, Human
uuugagaccagcuugugcaacaug

SEQ ID NO: 545523 - RNA, 32 nt, Human
uuugagaccaggcuggccaacauggcaaaacc

SEQ ID NO: 545524 - RNA, 32 nt, Human
uuugagaccaggcugggcaacauagugagacc

SEQ ID NO: 545525 - RNA, 32 nt, Human
uuugagaccaggcugggcaacauggugaaacc

SEQ ID NO: 545526 - RNA, 32 nt, Human
uuugagaccagucugaccaacauggagaaacc

SEQ ID NO: 545527 - RNA, 32 nt, Human
uuugagaccagucuggccaaaauaguggaacc

SEQ ID NO: 545528 - RNA, 32 nt, Human
uuugagaccagucuggccaacaaggcgaaacc

SEQ ID NO: 545529 - RNA, 24 nt, Human
uuugagaccagucuggccaacaug

SEQ ID NO: 545530 - RNA, 32 nt, Human
uuugagaccagucuggccaacauggcgaaacc

SEQ ID NO: 545531 - RNA, 32 nt, Human
uuugagaccagucuggccaacauggugaaacc

SEQ ID NO: 545532 - RNA, 32 nt, Human
uuugagaccaguguggccaacauggugaaacc

SEQ ID NO: 545533 - RNA, 24 nt, Human
uuugagaccaguuugggcaacaua

SEQ ID NO: 545534 - RNA, 32 nt, Human
uuugagaccaguuugggcaacauagugagauc

SEQ ID NO: 545535 - RNA, 32 nt, Human
uuugagaccauccugaguaacauggugaaacc

SEQ ID NO: 545536 - RNA, 32 nt, Human
uuugagaccauccuggccaacauggugaaacc

SEQ ID NO: 545537 - RNA, 32 nt, Human
uuugagaccauccuggcuaacauggugaaacc

SEQ ID NO: 545538 - RNA, 32 nt, Human
uuugagaccauccugggcaacauagggagauc

SEQ ID NO: 545539 - RNA, 24 nt, Human
uuugagaccauccugggcaacaug

SEQ ID NO: 545540 - RNA, 32 nt, Human
uuugagaccauccugggcaacauggcgaaacc

SEQ ID NO: 545541 - RNA, 24 nt, Human
uuugagaccggccuggccaacaug

SEQ ID NO: 545542 - RNA, 32 nt, Human
uuugagaccggccuggccaacauggugaaacc

SEQ ID NO: 545543 - RNA, 24 nt, Human
uuugagaccggccuggccagcgug

SEQ ID NO: 545544 - RNA, 32 nt, Human
uuugagaccggccuggccagcguggugaagcc

SEQ ID NO: 545545 - RNA, 32 nt, Human
uuugagaccggucggcacugugcagagaucag

SEQ ID NO: 545546 - RNA, 32 nt, Human
uuugagaccuaagaaagguuguguaagcagaa

SEQ ID NO: 545547 - RNA, 32 nt, Human
uuugagaccuagggcuggagugcaguugagcg

SEQ ID NO: 545548 - RNA, 32 nt, Human
uuugagaccugccuggccaacaugaugaaacc

SEQ ID NO: 545549 - RNA, 24 nt, Human
uuugagaccugccugggcaacaua

SEQ ID NO: 545550 - RNA, 32 nt, Human
uuugagacgaguuucgcucuguugcccaggcu

SEQ ID NO: 545551 - RNA, 24 nt, Human
uuugagacuagacugggcaacaua

SEQ ID NO: 545552 - RNA, 32 nt, Human
uuugagacuagacugggcaacauagcaagacc

SEQ ID NO: 545553 - RNA, 24 nt, Human
uuugagacuagccuaggcaacaca

SEQ ID NO: 545554 - RNA, 32 nt, Human
uuugagacuagccucacuaacauggugaaacc

SEQ ID NO: 545555 - RNA, 32 nt, Human
uuugagacuagccugaccaacauggagaaauc

SEQ ID NO: 545556 - RNA, 32 nt, Human
uuugagacuagccuggcaaacaugaugaaacc

SEQ ID NO: 545557 - RNA, 24 nt, Human
uuugagacuagccuggccaacaua

SEQ ID NO: 545558 - RNA, 32 nt, Human
uuugagacuagccuggccaacauggugagacc

SEQ ID NO: 545559 - RNA, 32 nt, Human
uuugagacuagccuggccaagauggugaaacc

SEQ ID NO: 545560 - RNA, 32 nt, Human
uuugagacuagccuggccaauauagugggacc

SEQ ID NO: 545561 - RNA, 32 nt, Human
uuugagacuagccuggccaauauggugaaacc

SEQ ID NO: 545562 - RNA, 24 nt, Human
uuugagacuagccuggccagcaug

SEQ ID NO: 545563 - RNA, 32 nt, Human
uuugagacuagccuggccagcauggugaaacc

SEQ ID NO: 545564 - RNA, 21 nt, Human
uuugagacuagccugggcaac

SEQ ID NO: 545565 - RNA, 24 nt, Human
uuugagacuagccugggcaacaua

SEQ ID NO: 545566 - RNA, 24 nt, Human
uuugagacuagccugggcaacaug

SEQ ID NO: 545567 - RNA, 32 nt, Human
uuugagacuagccugggcaacauggugaaacc

SEQ ID NO: 545568 - RNA, 32 nt, Human
uuugagacuagccugggcaacauggugagacc

SEQ ID NO: 545569 - RNA, 24 nt, Human
uuugagacuagccugggcaaccca

SEQ ID NO: 545570 - RNA, 24 nt, Human
uuugagacuagccugggcaauaug

SEQ ID NO: 545571 - RNA, 24 nt, Human
uuugagacuagccuggucagcaug

SEQ ID NO: 545572 - RNA, 24 nt, Human
uuugagacuagcuuggccaacaua

SEQ ID NO: 545573 - RNA, 32 nt, Human
uuugagacuagcuuggccaacauagugaaacc

SEQ ID NO: 545574 - RNA, 24 nt, Human
uuugagacuagucuggccaacaug

SEQ ID NO: 545575 - RNA, 32 nt, Human
uuugagacuagucuggccaacauggugaaaca

SEQ ID NO: 545576 - RNA, 32 nt, Human
uuugagacucacuuccucaucucccuguccuc

SEQ ID NO: 545577 - RNA, 32 nt, Human
uuugagacuccucagcaccccuccaguuuugc

SEQ ID NO: 545578 - RNA, 24 nt, Human
uuugagacuggccugggcagcaua

SEQ ID NO: 545579 - RNA, 32 nt, Human
uuugagacugggucucgcuuuguugcccaggc

SEQ ID NO: 545580 - RNA, 32 nt, Human
uuugagacuguucacucaaauagggcagagua

SEQ ID NO: 545581 - RNA, 32 nt, Human
uuugagagaaggagggaggaaaagguguccug

SEQ ID NO: 545582 - RNA, 32 nt, Human
uuugagagagucaagacucuuucuuaagggcc

SEQ ID NO: 545583 - RNA, 19 nt, Human
uuugagagagucucacucu

SEQ ID NO: 545584 - RNA, 32 nt, Human
uuugagagagugaaaggaagagacagauacuu

SEQ ID NO: 545585 - RNA, 32 nt, Human
uuugagagaucgcaugccccagccuuuccauc

SEQ ID NO: 545586 - RNA, 24 nt, Human
uuugagagcagccagggcaacaca

SEQ ID NO: 545587 - RNA, 32 nt, Human
uuugagagcagccuggccaacagaggugagca

SEQ ID NO: 545588 - RNA, 32 nt, Human
uuugagagcagccuggcuaacauggugaaacc

SEQ ID NO: 545589 - RNA, 32 nt, Human
uuugagaggccaaggagguggaucaauugagg

SEQ ID NO: 545590 - RNA, 32 nt, Human
uuugagaggcugcucuggaauaugucucaaug

SEQ ID NO: 545591 - RNA, 32 nt, Human
uuugagagggccugaaagcagaugccccagcc

SEQ ID NO: 545592 - RNA, 32 nt, Human
uuugagagugcuguaugcgguucccuuucaug

SEQ ID NO: 545593 - RNA, 24 nt, Human
uuugagaucagcccgggcaacaug

SEQ ID NO: 545594 - RNA, 32 nt, Human
uuugagaucagcccgggcaacauggugaaacc

SEQ ID NO: 545595 - RNA, 24 nt, Human
uuugagaucagccuaggcaacaug

SEQ ID NO: 545596 - RNA, 32 nt, Human
uuugagaucagccuaggcaacauggcaaaacc

SEQ ID NO: 545597 - RNA, 32 nt, Human
uuugagaucagccugcccaacauggugaaacc

SEQ ID NO: 545598 - RNA, 32 nt, Human
uuugagaucagccuggacaacagaccugagcc

SEQ ID NO: 545599 - RNA, 32 nt, Human
uuugagaucagccuggagaacaaagugagacc

SEQ ID NO: 545600 - RNA, 32 nt, Human
uuugagaucagccuggcaaacauggcgacacc

SEQ ID NO: 545601 - RNA, 32 nt, Human
uuugagaucagccuggccaacagacgugagcc

SEQ ID NO: 545602 - RNA, 32 nt, Human
uuugagaucagccuggccaacauagugaaacc

SEQ ID NO: 545603 - RNA, 24 nt, Human
uuugagaucagccuggccaacaug

SEQ ID NO: 545604 - RNA, 32 nt, Human
uuugagaucagccuggccaacauggugaaacc

SEQ ID NO: 545605 - RNA, 24 nt, Human
uuugagaucagccuggccaauaug

SEQ ID NO: 545606 - RNA, 32 nt, Human
uuugagaucagccuggccaauauggugaaacc

SEQ ID NO: 545607 - RNA, 24 nt, Human
uuugagaucagccuggccaaugug

SEQ ID NO: 545608 - RNA, 32 nt, Human
uuugagaucagccuggccaaugugguaaaacc

SEQ ID NO: 545609 - RNA, 32 nt, Human
uuugagaucagccuggccaauguggugaaacc

SEQ ID NO: 545610 - RNA, 24 nt, Human
uuugagaucagccuggccagcaug

SEQ ID NO: 545611 - RNA, 32 nt, Human
uuugagaucagccuggccagcauggcgaaacc

SEQ ID NO: 545612 - RNA, 24 nt, Human
uuugagaucagccugggaaacaua

SEQ ID NO: 545613 - RNA, 24 nt, Human
uuugagaucagccugggcaacaua

SEQ ID NO: 545614 - RNA, 24 nt, Human
uuugagaucagccugggcaacaug

SEQ ID NO: 545615 - RNA, 32 nt, Human
uuugagaucagccugggcaacauggugaaacc

SEQ ID NO: 545616 - RNA, 32 nt, Human
uuugagaucagccugggcaacaugguggaacc

SEQ ID NO: 545617 - RNA, 24 nt, Human
uuugagaucagccugggcaaugug

SEQ ID NO: 545618 - RNA, 32 nt, Human
uuugagaucagccuggucaacagagcgauauc

SEQ ID NO: 545619 - RNA, 21 nt, Human
uuugagaucaggaguucaaga

SEQ ID NO: 545620 - RNA, 32 nt, Human
uuugagaucaugcugaaggccaagcaggcccg

SEQ ID NO: 545621 - RNA, 32 nt, Human
uuugagauccuggccaagaccccguauggcca

SEQ ID NO: 545622 - RNA, 32 nt, Human
uuugagaucggccugggcaacauaguaagacc

SEQ ID NO: 545623 - RNA, 32 nt, Human
uuugagaugaaugcagacaucacaaaguaguu

SEQ ID NO: 545624 - RNA, 32 nt, Human
uuugagaugaguuucacucuuguugcccaggc

SEQ ID NO: 545625 - RNA, 32 nt, Human
uuugagaugcccgccccgccuccgagaccccg

SEQ ID NO: 545626 - RNA, 24 nt, Human
uuugagaugcgccugggcaacaua

SEQ ID NO: 545627 - RNA, 32 nt, Human
uuugagauggagucucgcuuuguugcccagac

SEQ ID NO: 545628 - RNA, 32 nt, Human
uuugagauggagucucgcuuuguugcccaggc

SEQ ID NO: 545629 - RNA, 32 nt, Human
uuugagauggagucucuugcucugucauccag

SEQ ID NO: 545630 - RNA, 32 nt, Human
uuugagauggagucuugcucuuuugccaggcu

SEQ ID NO: 545631 - RNA, 32 nt, Human
uuugagauggucuugcucuguugcccaggcug

SEQ ID NO: 545632 - RNA, 32 nt, Human
uuugagauuagccuggccaagauggugaaacc

SEQ ID NO: 545633 - RNA, 32 nt, Human
uuugagauuggaaacuucuugccuugaacaga

SEQ ID NO: 545634 - RNA, 32 nt, Human
uuugagcaacuaacuaaccacauuuuaggauc

SEQ ID NO: 545635 - RNA, 32 nt, Human
uuugagcaagggaagguagccuggaugagcug

SEQ ID NO: 545636 - RNA, 32 nt, Human
uuugagcacaauaugcagcacauaacuuuuca

SEQ ID NO: 545637 - RNA, 32 nt, Human
uuugagcacugcacuguuucucccucccuugg

SEQ ID NO: 545638 - RNA, 32 nt, Human
uuugagcagcuuuuggaaccacaguguuugcc

SEQ ID NO: 545639 - RNA, 32 nt, Human
uuugagcaggucucccuuuuacucuucccaac

SEQ ID NO: 545640 - RNA, 32 nt, Human
uuugagcaucaucucggcuuacauuuucucug

SEQ ID NO: 545641 - RNA, 32 nt, Human
uuugagccagccuggccaacauggugaaaccc

SEQ ID NO: 545642 - RNA, 32 nt, Human
uuugagcccagagguagaggcugcagugagcc

SEQ ID NO: 545643 - RNA, 32 nt, Human
uuugagcccagccuaggcaacauagcgagacc

SEQ ID NO: 545644 - RNA, 32 nt, Human
uuugagcccagcuugagcaacauagugaaauc

SEQ ID NO: 545645 - RNA, 32 nt, Human
uuugagcccaggaaucugagaccagccugagc

SEQ ID NO: 545646 - RNA, 32 nt, Human
uuugagcccaggaauuggaaagcagccuggcc

SEQ ID NO: 545647 - RNA, 32 nt, Human
uuugagcccaggaauuugaggcugcagcgagc

SEQ ID NO: 545648 - RNA, 32 nt, Human
uuugagcccaggaauuugaggcugcagugagc

SEQ ID NO: 545649 - RNA, 32 nt, Human
uuugagcccaggaggcagaauuugcagugagc

SEQ ID NO: 545650 - RNA, 32 nt, Human
uuugagcccaggaggcugaggcugcaaugacu

SEQ ID NO: 545651 - RNA, 32 nt, Human
uuugagcccaggaggucaaggcugcagugagc

SEQ ID NO: 545652 - RNA, 32 nt, Human
uuugagcccaggaggucgaggcugcagugggc

SEQ ID NO: 545653 - RNA, 32 nt, Human
uuugagcccaggagguugaggcugcagugagu

SEQ ID NO: 545654 - RNA, 32 nt, Human
uuugagcccaggaguucaaggcagcaaugagc

SEQ ID NO: 545655 - RNA, 32 nt, Human
uuugagcccaggaguucaaggccagccugggc

SEQ ID NO: 545656 - RNA, 32 nt, Human
uuugagcccaggaguuccagaccagccuaggc

SEQ ID NO: 545657 - RNA, 32 nt, Human
uuugagcccaggaguucgagaccaaccugggc

SEQ ID NO: 545658 - RNA, 32 nt, Human
uuugagcccaggaguugaagaccagccugggc

SEQ ID NO: 545659 - RNA, 32 nt, Human
uuugagcccaggaguuugagaccagcuggggc

SEQ ID NO: 545660 - RNA, 32 nt, Human
uuugagcccaggaguuugaggcugcagugagc

SEQ ID NO: 545661 - RNA, 32 nt, Human
uuugagcccgggaggucgaggcuacaguaagc

SEQ ID NO: 545662 - RNA, 32 nt, Human
uuugagcccugaaagucgagguugcagugagc

SEQ ID NO: 545663 - RNA, 32 nt, Human
uuugagcccuggagguugaggcugcagugagc

SEQ ID NO: 545664 - RNA, 32 nt, Human
uuugagccgccuggccuugcucaguuuauuuu

SEQ ID NO: 545665 - RNA, 32 nt, Human
uuugagccuaggaggucaaggcugcagugagc

SEQ ID NO: 545666 - RNA, 21 nt, Human
uuugagccuaggaguucgaga

SEQ ID NO: 545667 - RNA, 32 nt, Human
uuugagccugcaagauggagguugcagugagc

SEQ ID NO: 545668 - RNA, 32 nt, Human
uuugagccugcaucuucuugcaucuaaugaaa

SEQ ID NO: 545669 - RNA, 32 nt, Human
uuugagccugggagaucgaggcugcagugagc

SEQ ID NO: 545670 - RNA, 32 nt, Human
uuugagccugggaggcagagguugcagugagc

SEQ ID NO: 545671 - RNA, 32 nt, Human
uuugagccugggaggucgaggcuguagugagc

SEQ ID NO: 545672 - RNA, 23 nt, Human
uuugagcuacaggacaaaggcug

SEQ ID NO: 545673 - RNA, 32 nt, Human
uuugagcucagcccuggugggcagagagguag

SEQ ID NO: 545674 - RNA, 32 nt, Human
uuugagcucaggaggcagagguugcagugagc

SEQ ID NO: 545675 - RNA, 21 nt, Human
uuugagcucaggaguucaaga

SEQ ID NO: 545676 - RNA, 27 nt, Human
uuugagcucauuauaaccacacuccug

SEQ ID NO: 545677 - RNA, 32 nt, Human
uuugagcuccgcuguggcagagccuggagcug

SEQ ID NO: 545678 - RNA, 32 nt, Human
uuugagcuccugccuggauucccagcacuuug

SEQ ID NO: 545679 - RNA, 32 nt, Human
uuugagcucucuucccaauauuuccuuuuggu

SEQ ID NO: 545680 - RNA, 32 nt, Human
uuugagcucugcagccucucuccuggagugag

SEQ ID NO: 545681 - RNA, 32 nt, Human
uuugagcugcagcagcuuuaacucuuacccuu

SEQ ID NO: 545682 - RNA, 32 nt, Human
uuugagcugcuccuuccugugugugcucugga

SEQ ID NO: 545683 - RNA, 32 nt, Human
uuugagcugcuccuuccugugugugcucuggg

SEQ ID NO: 545684 - RNA, 20 nt, Human
uuugagcuggaaaggauguc

SEQ ID NO: 545685 - RNA, 32 nt, Human
uuugagcugugccauuuaugguacucuuugcc

SEQ ID NO: 545686 - RNA, 30 nt, Human
uuugagcuucauuucaggcuccuguggcug

SEQ ID NO: 545687 - RNA, 32 nt, Human
uuugagcuucuccucugcuccaacagacaccu

SEQ ID NO: 545688 - RNA, 32 nt, Human
uuugagcuuugaaagcagucacugugguguaa

SEQ ID NO: 545689 - RNA, 32 nt, Human
uuugaggaaauagaauucgccaaaccaaugca

SEQ ID NO: 545690 - RNA, 32 nt, Human
uuugaggaacagcagaaaaaugauguggaaaa

SEQ ID NO: 545691 - RNA, 32 nt, Human
uuugaggaaguccccaacacagugacucugac

SEQ ID NO: 545692 - RNA, 32 nt, Human
uuugaggacaaccauuccagacugcuuccaau

SEQ ID NO: 545693 - RNA, 32 nt, Human
uuugaggacagcuucaaucgcggugugaagaa

SEQ ID NO: 545694 - RNA, 32 nt, Human
uuugaggacuggugucacugaauggcucgagc

SEQ ID NO: 545695 - RNA, 32 nt, Human
uuugaggaggcaggagauuccgugggucccug

SEQ ID NO: 545696 - RNA, 32 nt, Human
uuugaggaugaaauucuccuccuucuucccuu

SEQ ID NO: 545697 - RNA, 32 nt, Human
uuugaggaugcuggggagagggggagggggcu

SEQ ID NO: 545698 - RNA, 32 nt, Human
uuugaggauuuaagaauuagggaaauaauuug

SEQ ID NO: 545699 - RNA, 31 nt, Human
uuugaggcaaugucucacuguuauccaggcu

SEQ ID NO: 545700 - RNA, 32 nt, Human
uuugaggcaggcgaggggcugggaguggguag

SEQ ID NO: 545701 - RNA, 32 nt, Human
uuugaggcauuucauuucuuuugcuaguucau

SEQ ID NO: 545702 - RNA, 24 nt, Human
uuugaggccagccagggcaacaca

SEQ ID NO: 545703 - RNA, 32 nt, Human
uuugaggccagccuggccaacauggcaaaacc

SEQ ID NO: 545704 - RNA, 32 nt, Human
uuugaggccagccuggccaacauggcgaaacc

SEQ ID NO: 545705 - RNA, 32 nt, Human
uuugaggccagccugggaaauauagugagacc

SEQ ID NO: 545706 - RNA, 24 nt, Human
uuugaggccagccugggcaacaua

SEQ ID NO: 545707 - RNA, 32 nt, Human
uuugaggccagccugggcaacauagagagacc

SEQ ID NO: 545708 - RNA, 32 nt, Human
uuugaggccagccugggcaacgugacgaaacc

SEQ ID NO: 545709 - RNA, 32 nt, Human
uuugaggccaggaguucaagaccagccugggc

SEQ ID NO: 545710 - RNA, 32 nt, Human
uuugaggccaggaguucaagaccagucuggcc

SEQ ID NO: 545711 - RNA, 32 nt, Human
uuugaggccaggaguucgauaccagccuggcc

SEQ ID NO: 545712 - RNA, 32 nt, Human
uuugaggccaggaguucuagaccagccuggcc

SEQ ID NO: 545713 - RNA, 32 nt, Human
uuugaggccaggaguuugagaccugccugggc

SEQ ID NO: 545714 - RNA, 32 nt, Human
uuugaggccagucuggccaaugugaugaaacc

SEQ ID NO: 545715 - RNA, 32 nt, Human
uuugaggccauuuugagccuuacucuuaaguu

SEQ ID NO: 545716 - RNA, 32 nt, Human
uuugaggccuugcccugcuccauccagagcaa

SEQ ID NO: 545717 - RNA, 32 nt, Human
uuugaggcggcacgcagccuagacgacagacu

SEQ ID NO: 545718 - RNA, 32 nt, Human
uuugaggcucagagacagagcagaagacagaa

SEQ ID NO: 545719 - RNA, 20 nt, Human
uuugaggcuggaugcagugg

SEQ ID NO: 545720 - RNA, 32 nt, Human
uuugagggaaaucauaaccaaaaguuuaaagg

SEQ ID NO: 545721 - RNA, 32 nt, Human
uuugagggaggcagaagucugcaguugaagaa

SEQ ID NO: 545722 - RNA, 32 nt, Human
uuugagggcagggggaguuuuauucuacaccc

SEQ ID NO: 545723 - RNA, 32 nt, Human
uuugagggcauccuauaaacacccaacuguuc

SEQ ID NO: 545724 - RNA, 32 nt, Human
uuugagggcuguacuagguuuaucucauuuaa

SEQ ID NO: 545725 - RNA, 32 nt, Human
uuugaggggauguggcacugagcccacaggag

SEQ ID NO: 545726 - RNA, 32 nt, Human
uuugaggggucugaagacugaaagagucgaau

SEQ ID NO: 545727 - RNA, 23 nt, Human
uuugagggugagggacagcacag

SEQ ID NO: 545728 - RNA, 32 nt, Human
uuugagggugagugccuccagcagaaacacag

SEQ ID NO: 545729 - RNA, 32 nt, Human
uuugaggucacugagguaggaagaccugucua

SEQ ID NO: 545730 - RNA, 32 nt, Human
uuugagguggaggauuucacaguuucuuuauu

SEQ ID NO: 545731 - RNA, 32 nt, Human
uuugaggugggaggggccauggagacugcagg

SEQ ID NO: 545732 - RNA, 32 nt, Human
uuugagguuggccuggacaacauggcgagacc

SEQ ID NO: 545733 - RNA, 32 nt, Human
uuugaguaacaaauaaauaagaucagacucug

SEQ ID NO: 545734 - RNA, 32 nt, Human
uuugaguaccuccaggcugaaggacuguugua

SEQ ID NO: 545735 - RNA, 32 nt, Human
uuugaguagaaaagggccuggaaagaggggag

SEQ ID NO: 545736 - RNA, 32 nt, Human
uuugaguagaaauggcuggacauacuucaaac

SEQ ID NO: 545737 - RNA, 32 nt, Human
uuugaguagagaaauuaugugugucauguggu

SEQ ID NO: 545738 - RNA, 32 nt, Human
uuugaguauccagagauuugugugugaaauga

SEQ ID NO: 545739 - RNA, 32 nt, Human
uuugagucacaucuuuuuagaaaaucaugaga

SEQ ID NO: 545740 - RNA, 32 nt, Human
uuugagucaccccagcccaggagucaaaaaua

SEQ ID NO: 545741 - RNA, 32 nt, Human
uuugagucacugggaucuuccuggugagaggu

SEQ ID NO: 545742 - RNA, 32 nt, Human
uuugagucauuuccacaucuugcgaguccuuc

SEQ ID NO: 545743 - RNA, 32 nt, Human
uuugagucccccaaacugccugaagacuuaag

SEQ ID NO: 545744 - RNA, 32 nt, Human
uuugaguccucauccauggagugcuguguuug

SEQ ID NO: 545745 - RNA, 32 nt, Human
uuugaguccuugcuucuguuugcucacaguaa

SEQ ID NO: 545746 - RNA, 32 nt, Human
uuugagucugacaaaaucagaguuaggaucuu

SEQ ID NO: 545747 - RNA, 32 nt, Human
uuugagucuuucuauguugucuagacggaggg

SEQ ID NO: 545748 - RNA, 32 nt, Human
uuugagugaaccugaccugauagccucaggau

SEQ ID NO: 545749 - RNA, 32 nt, Human
uuugagugacucuggagccaucuuugaagccc

SEQ ID NO: 545750 - RNA, 32 nt, Human
uuugagugcaguugguacaguacuuugguguc

SEQ ID NO: 545751 - RNA, 32 nt, Human
uuugagugcugaagacuucucccaucuccacg

SEQ ID NO: 545752 - RNA, 32 nt, Human
uuugagugcugucucuggacaucuucagccca

SEQ ID NO: 545753 - RNA, 32 nt, Human
uuugaguguagggagugugggagcagccuugg

SEQ ID NO: 545754 - RNA, 32 nt, Human
uuugagugugcagaguacauggggaaggggcu

SEQ ID NO: 545755 - RNA, 32 nt, Human
uuugaguguuagagaaaggagugaaggaggca

SEQ ID NO: 545756 - RNA, 24 nt, Human
uuugaguguuucccuuuuuugcca

SEQ ID NO: 545757 - RNA, 32 nt, Human
uuugaguucagccuggguagcauaugggaacu

SEQ ID NO: 545758 - RNA, 32 nt, Human
uuugaguucaggaagugugacaaggauuugga

SEQ ID NO: 545759 - RNA, 21 nt, Human
uuugaguucaggaguucaaga

SEQ ID NO: 545760 - RNA, 32 nt, Human
uuugaguucccugcaucugccaccguaguuuc

SEQ ID NO: 545761 - RNA, 32 nt, Human
uuugaguucugaggagaaaacuaacucuuuuc

SEQ ID NO: 545762 - RNA, 32 nt, Human
uuugaguucuggguauccucccuuucuguaac

SEQ ID NO: 545763 - RNA, 32 nt, Human
uuugaguugcccacauacugcaguuauucugu

SEQ ID NO: 545764 - RNA, 32 nt, Human
uuugaguugggaucuugugcucugucacccag

SEQ ID NO: 545765 - RNA, 32 nt, Human
uuugaguugucccgccuuucuggaccaaacca

SEQ ID NO: 545766 - RNA, 32 nt, Human
uuugaguuucaucaaaugaauguccuucacau

SEQ ID NO: 545767 - RNA, 32 nt, Human
uuugaguuucucucacauuacuguauauacuu

SEQ ID NO: 545768 - RNA, 32 nt, Human
uuugaguuuggguucuccccagccccuuggcc

SEQ ID NO: 545769 - RNA, 32 nt, Human
uuugaguuuuagaauuagucauucuuuagagc

SEQ ID NO: 545770 - RNA, 32 nt, Human
uuugauaaccucucuccauccugggccugaug

SEQ ID NO: 545771 - RNA, 32 nt, Human
uuugauaagacaggguauugccguguuggcca

SEQ ID NO: 545772 - RNA, 32 nt, Human
uuugauaagcugcugaagaagcucacaaguca

SEQ ID NO: 545773 - RNA, 32 nt, Human
uuugauaagcuuggggacaacaucccaauaga

SEQ ID NO: 545774 - RNA, 32 nt, Human
uuugauaauaaagaugacauugccaguuuugu

SEQ ID NO: 545775 - RNA, 32 nt, Human
uuugauaaugaacagugagagauuuuuaaaua

SEQ ID NO: 545776 - RNA, 32 nt, Human
uuugauacaugcuuuuauuuuccuucauuuuu

SEQ ID NO: 545777 - RNA, 32 nt, Human
uuugauaccagccugaccaacauggagaaacc

SEQ ID NO: 545778 - RNA, 32 nt, Human
uuugauaccagccuggccaacauggugaaacc

SEQ ID NO: 545779 - RNA, 20 nt, Human
uuugauaccauucaagugaa

SEQ ID NO: 545780 - RNA, 32 nt, Human
uuugauacuacugguugcuaauguucuggcau

SEQ ID NO: 545781 - RNA, 32 nt, Human
uuugauacuacuguagaacacuauuuuuaaua

SEQ ID NO: 545782 - RNA, 32 nt, Human
uuugauacuauuuggcuuaaucaucuucacuu

SEQ ID NO: 545783 - RNA, 32 nt, Human
uuugauacucucuaccuccuccagaaacacga

SEQ ID NO: 545784 - RNA, 32 nt, Human
uuugauagaaucuugcucugucgcccaggcug

SEQ ID NO: 545785 - RNA, 32 nt, Human
uuugauagcacgcuauucuuuccuucauggca

SEQ ID NO: 545786 - RNA, 32 nt, Human
uuugauagccaucuauucaucuggaucauggg

SEQ ID NO: 545787 - RNA, 32 nt, Human
uuugauaucucucaauagaauguugcaguuuu

SEQ ID NO: 545788 - RNA, 32 nt, Human
uuugauaugacaacaaccccuccaucacaagu

SEQ ID NO: 545789 - RNA, 32 nt, Human
uuugauauggcagaccuaggaaacaaauacag

SEQ ID NO: 545790 - RNA, 25 nt, Human
uuugauaugucugcaugcagcacag

SEQ ID NO: 545791 - RNA, 32 nt, Human
uuugauaugucuucauuuaauuuugugaaguc

SEQ ID NO: 545792 - RNA, 32 nt, Human
uuugauauuucucaaggcccuagucucugcug

SEQ ID NO: 545793 - RNA, 22 nt, Human
uuugaucaaccuuuaguuggaa

SEQ ID NO: 545794 - RNA, 32 nt, Human
uuugaucacaccacugcacuccagccugggca

SEQ ID NO: 545795 - RNA, 32 nt, Human
uuugaucacagaacuucuagaauaacccagau

SEQ ID NO: 545796 - RNA, 32 nt, Human
uuugaucacuguggucacagaccugguacugg

SEQ ID NO: 545797 - RNA, 32 nt, Human
uuugaucagaucagugucagaagauuacuucu

SEQ ID NO: 545798 - RNA, 32 nt, Human
uuugauccaagcagguuggggaacauauuggu

SEQ ID NO: 545799 - RNA, 32 nt, Human
uuugauccaagugcccacaguucugaugaaug

SEQ ID NO: 545800 - RNA, 32 nt, Human
uuugauccuccgaaucuggagauguuguagag

SEQ ID NO: 545801 - RNA, 32 nt, Human
uuugauccuccuuuacauagcacagcuauaua

SEQ ID NO: 545802 - RNA, 32 nt, Human
uuugaucugucucccuuuaguuuugccggauu

SEQ ID NO: 545803 - RNA, 32 nt, Human
uuugaucuguuuugaaaaagauaaagagccuc

SEQ ID NO: 545804 - RNA, 32 nt, Human
uuugaucuuccucugcuaaauugauguugaug

SEQ ID NO: 545805 - RNA, 32 nt, Human
uuugaucuucuuuuucuuuucucccccucuuu

SEQ ID NO: 545806 - RNA, 29 nt, Human
uuugaugacagaaaacaucacacagaaag

SEQ ID NO: 545807 - RNA, 32 nt, Human
uuugaugaguuucuuguaagguuaccguuucu

SEQ ID NO: 545808 - RNA, 32 nt, Human
uuugaugauacagauuuaagaauaccugagac

SEQ ID NO: 545809 - RNA, 32 nt, Human
uuugaugaugucuccaucuacuuuuccacucc

SEQ ID NO: 545810 - RNA, 32 nt, Human
uuugaugcaacuuauuuguaagaaggauuuuu

SEQ ID NO: 545811 - RNA, 32 nt, Human
uuugaugcaccuuagagaacaguaggagcagc

SEQ ID NO: 545812 - RNA, 32 nt, Human
uuugaugccaacuuuauguguaaagaagcuaa

SEQ ID NO: 545813 - RNA, 32 nt, Human
uuugaugccacugguuugucuccugggcccuc

SEQ ID NO: 545814 - RNA, 32 nt, Human
uuugaugccaggacacgcuuuggaggcgauuu

SEQ ID NO: 545815 - RNA, 32 nt, Human
uuugaugcucuucucaaggugcacugacugag

SEQ ID NO: 545816 - RNA, 32 nt, Human
uuugauggagagaaagcuguaggauccauaaa

SEQ ID NO: 545817 - RNA, 32 nt, Human
uuugauggagcgugucaguauugugugacgcu

SEQ ID NO: 545818 - RNA, 32 nt, Human
uuugauggcuggggccagucucuugucacuuu

SEQ ID NO: 545819 - RNA, 32 nt, Human
uuugauggcuguaacuggaagcaacacuccug

SEQ ID NO: 545820 - RNA, 32 nt, Human
uuugaugggaagaaugaggaccugguugauaa

SEQ ID NO: 545821 - RNA, 19 nt, Human
uuugaugggauaaggaagc

SEQ ID NO: 545822 - RNA, 29 nt, Human
uuugaugggggccuucuucuccccauguc

SEQ ID NO: 545823 - RNA, 32 nt, Human
uuugauggggucuucauuguccagaaauaccu

SEQ ID NO: 545824 - RNA, 32 nt, Human
uuugauggggucuugcuaugucucccaggcug

SEQ ID NO: 545825 - RNA, 32 nt, Human
uuugaugggucugacuauaugcacacaccuuu

SEQ ID NO: 545826 - RNA, 32 nt, Human
uuugaugguuucuauucugacugacaucaauu

SEQ ID NO: 545827 - RNA, 32 nt, Human
uuugaugguuugaaugcuugcuuucuuguagu

SEQ ID NO: 545828 - RNA, 32 nt, Human
uuugaugucacugacugucuacauguauuuau

SEQ ID NO: 545829 - RNA, 32 nt, Human
uuugaugucaugaggacaggauguuugugucu

SEQ ID NO: 545830 - RNA, 32 nt, Human
uuugaugucucaucuucauuguuuucacucuu

SEQ ID NO: 545831 - RNA, 23 nt, Human
uuugaugugaaauuugggaacag

SEQ ID NO: 545832 - RNA, 32 nt, Human
uuugauguggaaucacagcugcagugauauau

SEQ ID NO: 545833 - RNA, 32 nt, Human
uuugauguuaaaugacauguauacaaauucuu

SEQ ID NO: 545834 - RNA, 32 nt, Human
uuugauguuaucuagccuagaaaugacacaga

SEQ ID NO: 545835 - RNA, 32 nt, Human
uuugauguuaucuuuggaugugcaaucugaaa

SEQ ID NO: 545836 - RNA, 21 nt, Human
uuugauguucagagcacacag

SEQ ID NO: 545837 - RNA, 32 nt, Human
uuugauguucugagguuugcuuugguuuuucc

SEQ ID NO: 545838 - RNA, 32 nt, Human
uuugauguugaaugaacuaguaagucacagua

SEQ ID NO: 545839 - RNA, 32 nt, Human
uuugauguuguagacuaggcuccugaguuaag

SEQ ID NO: 545840 - RNA, 32 nt, Human
uuugauguuuaugaggaugauugcugguuucc

SEQ ID NO: 545841 - RNA, 32 nt, Human
uuugauguuuuuaaaauuuugucuucucugug

SEQ ID NO: 545842 - RNA, 32 nt, Human
uuugauuaagagaagucuugggaagauaggua

SEQ ID NO: 545843 - RNA, 32 nt, Human
uuugauuacacaaaagccaauuuuaccuuccc

SEQ ID NO: 545844 - RNA, 32 nt, Human
uuugauuacaccccugcacuccagccugggcg

SEQ ID NO: 545845 - RNA, 32 nt, Human
uuugauuaccaccaccaucugaccuggucuua

SEQ ID NO: 545846 - RNA, 32 nt, Human
uuugauuacgcauucaccuguucauucauuca

SEQ ID NO: 545847 - RNA, 32 nt, Human
uuugauuaggaaacaguuuggccaaaguacca

SEQ ID NO: 545848 - RNA, 32 nt, Human
uuugauucauagguaggagggcuuagauuuua

SEQ ID NO: 545849 - RNA, 32 nt, Human
uuugauucauuugaguuaacagugguguuagu

SEQ ID NO: 545850 - RNA, 32 nt, Human
uuugauuccauuccucaagauaauuuuagagu

SEQ ID NO: 545851 - RNA, 32 nt, Human
uuugauuccucccagguuguucccugccuggu

SEQ ID NO: 545852 - RNA, 32 nt, Human
uuugauucuaugguucccucaguauuacaucu

SEQ ID NO: 545853 - RNA, 32 nt, Human
uuugauucuccaguauuccuguuuccauccag

SEQ ID NO: 545854 - RNA, 32 nt, Human
uuugauucuguccucuggaaaaugggcugcuu

SEQ ID NO: 545855 - RNA, 32 nt, Human
uuugauucuuucuauguugcccaggcugaucu

SEQ ID NO: 545856 - RNA, 32 nt, Human
uuugauugaacacaggcuugacagaaucuucu

SEQ ID NO: 545857 - RNA, 32 nt, Human
uuugauugccugcucuuuccagacacaacugc

SEQ ID NO: 545858 - RNA, 32 nt, Human
uuugauugcuggcaucuugccaccccagguau

SEQ ID NO: 545859 - RNA, 32 nt, Human
uuugauuguaauugcguuaaaucuuuugagag

SEQ ID NO: 545860 - RNA, 32 nt, Human
uuugauuguguaagggucuaaccacaacaaaa

SEQ ID NO: 545861 - RNA, 32 nt, Human
uuugauuuacagggaccuugcugcaguaaaua

SEQ ID NO: 545862 - RNA, 32 nt, Human
uuugauuucagccugcccuugccagugccugg

SEQ ID NO: 545863 - RNA, 32 nt, Human
uuugauuucccaaagagaacauuugcauuugu

SEQ ID NO: 545864 - RNA, 32 nt, Human
uuugauuucccuaggauggaagaguauaggug

SEQ ID NO: 545865 - RNA, 32 nt, Human
uuugauuuccucuucucucccuucaagcccca

SEQ ID NO: 545866 - RNA, 32 nt, Human
uuugauuucucauuugcugccagugucacauu

SEQ ID NO: 545867 - RNA, 32 nt, Human
uuugauuucugaccuuguaccucucuuugaug

SEQ ID NO: 545868 - RNA, 32 nt, Human
uuugauuucuuuaacagaggugagacuauuca

SEQ ID NO: 545869 - RNA, 32 nt, Human
uuugauuugccucccuaaccuuuucuagggcu

SEQ ID NO: 545870 - RNA, 32 nt, Human
uuugauuugccuggagucuuuuggaggcauga

SEQ ID NO: 545871 - RNA, 32 nt, Human
uuugauuuugcacugagccaaaggucuagcau

SEQ ID NO: 545872 - RNA, 32 nt, Human
uuugauuuugcauuuugcacuuccucccagga

SEQ ID NO: 545873 - RNA, 32 nt, Human
uuugcaaaacaugcucuucuaauuugaucaaa

SEQ ID NO: 545874 - RNA, 32 nt, Human
uuugcaaaaugucaauucucuaaaaauguguc

SEQ ID NO: 545875 - RNA, 32 nt, Human
uuugcaaacacguggauggaacuggggucaug

SEQ ID NO: 545876 - RNA, 32 nt, Human
uuugcaaacagaaacuauagcagacacauaaa

SEQ ID NO: 545877 - RNA, 32 nt, Human
uuugcaaaccugcaccuugcacuuuuggguuc

SEQ ID NO: 545878 - RNA, 32 nt, Human
uuugcaaacuauauaaagacauaugcaguaaa

SEQ ID NO: 545879 - RNA, 32 nt, Human
uuugcaaagagcucaauugcucugagcucagc

SEQ ID NO: 545880 - RNA, 32 nt, Human
uuugcaaagcccuugcauuguaugacaugagg

SEQ ID NO: 545881 - RNA, 32 nt, Human
uuugcaaagggaaauuaaagaaagaauguugc

SEQ ID NO: 545882 - RNA, 32 nt, Human
uuugcaaagucacagaccauugccucagaagg

SEQ ID NO: 545883 - RNA, 22 nt, Human
uuugcaaauaggaaacccccuu

SEQ ID NO: 545884 - RNA, 32 nt, Human
uuugcaaaucagaggauagaaaauguuaugcu

SEQ ID NO: 545885 - RNA, 32 nt, Human
uuugcaaaucuuaagacuaacaaauccuugaa

SEQ ID NO: 545886 - RNA, 31 nt, Human
uuugcaaaucuuuucuguucuguagguuguu

SEQ ID NO: 545887 - RNA, 32 nt, Human
uuugcaaauuaguaucacaacugcuaaguaga

SEQ ID NO: 545888 - RNA, 32 nt, Human
uuugcaaauuccaggggaucaagacuauugau

SEQ ID NO: 545889 - RNA, 20 nt, Human
uuugcaacaagaccauuuua

SEQ ID NO: 545890 - RNA, 32 nt, Human
uuugcaacacaaaagcauaugcagccccuaaa

SEQ ID NO: 545891 - RNA, 32 nt, Human
uuugcaacaucucauuucuuccuuuugcuguu

SEQ ID NO: 545892 - RNA, 32 nt, Human
uuugcaaccacaccuccgccucccuuggaaga

SEQ ID NO: 545893 - RNA, 32 nt, Human
uuugcaaccagccugagcaaaauauugagacu

SEQ ID NO: 545894 - RNA, 32 nt, Human
uuugcaaccaucagaauucagaaucuauagug

SEQ ID NO: 545895 - RNA, 20 nt, Human
uuugcaacuauuuccaccuc

SEQ ID NO: 545896 - RNA, 32 nt, Human
uuugcaacucacugauucucuacaugcucuuu

SEQ ID NO: 545897 - RNA, 32 nt, Human
uuugcaacugaaauuuauuuugccaauguuuu

SEQ ID NO: 545898 - RNA, 32 nt, Human
uuugcaacugcacuccagccugggcuacagag

SEQ ID NO: 545899 - RNA, 32 nt, Human
uuugcaagaauaagcaaagcccauggaauuua

SEQ ID NO: 545900 - RNA, 32 nt, Human
uuugcaagagcaccucuucagauauggcaccu

SEQ ID NO: 545901 - RNA, 32 nt, Human
uuugcaaggauacggcuucaguauuacuaauu

SEQ ID NO: 545902 - RNA, 32 nt, Human
uuugcaaguuuccugugaaaacaucaguuucc

SEQ ID NO: 545903 - RNA, 32 nt, Human
uuugcaaucuacagcuaguagagacuuugagg

SEQ ID NO: 545904 - RNA, 31 nt, Human
uuugcaaugucaggcuuugaaaacuuaaaca

SEQ ID NO: 545905 - RNA, 32 nt, Human
uuugcaauuauaaucacuccuacuuucuaagc

SEQ ID NO: 545906 - RNA, 26 nt, Human
uuugcaauugucacaacuaggagagg

SEQ ID NO: 545907 - RNA, 32 nt, Human
uuugcaauuuggaauuugugugaguugauuua

SEQ ID NO: 545908 - RNA, 32 nt, Human
uuugcacaaagaaaaugcuauuuuuggagcca

SEQ ID NO: 545909 - RNA, 32 nt, Human
uuugcacaaccuccaagccucugcagcagaca

SEQ ID NO: 545910 - RNA, 32 nt, Human
uuugcacaagggcaugaccuuuuuacuagacc

SEQ ID NO: 545911 - RNA, 32 nt, Human
uuugcacacaacauucaaaacacuucauauug

SEQ ID NO: 545912 - RNA, 32 nt, Human
uuugcacacagccccaggcuccacacagaaau

SEQ ID NO: 545913 - RNA, 32 nt, Human
uuugcacacaucaaaaguauugugauauuuuc

SEQ ID NO: 545914 - RNA, 25 nt, Human
uuugcacacccgcucuccggcccgc

SEQ ID NO: 545915 - RNA, 32 nt, Human
uuugcacacgcugaugaacgugcucaagaagg

SEQ ID NO: 545916 - RNA, 32 nt, Human
uuugcacagaacuucauuuugaaaguguuuuu

SEQ ID NO: 545917 - RNA, 32 nt, Human
uuugcacagacaccucuaccuucagcacuaug

SEQ ID NO: 545918 - RNA, 31 nt, Human
uuugcacagcccucugggcgcacugugugcc

SEQ ID NO: 545919 - RNA, 32 nt, Human
uuugcacagcucaucuggccagaagagcugag

SEQ ID NO: 545920 - RNA, 32 nt, Human
uuugcacaggcugagugcaaugccgugaucuc

SEQ ID NO: 545921 - RNA, 32 nt, Human
uuugcacaucuacauccagaacagugagaacg

SEQ ID NO: 545922 - RNA, 32 nt, Human
uuugcacaugcccuuuuucaguccaauugaac

SEQ ID NO: 545923 - RNA, 32 nt, Human
uuugcacauggugacuuucccacugugccaug

SEQ ID NO: 545924 - RNA, 32 nt, Human
uuugcacauuuccaccaugguggcuggugugg

SEQ ID NO: 545925 - RNA, 32 nt, Human
uuugcaccaucuuuuauagccacauucuccau

SEQ ID NO: 545926 - RNA, 32 nt, Human
uuugcaccaugaguuugugaaaaaucuggauu

SEQ ID NO: 545927 - RNA, 32 nt, Human
uuugcacccacugcauuugcagccuugagguc

SEQ ID NO: 545928 - RNA, 32 nt, Human
uuugcaccgcuguacuccagccugggcaacag

SEQ ID NO: 545929 - RNA, 22 nt, Human
uuugcaccuucucagugcugua

SEQ ID NO: 545930 - RNA, 32 nt, Human
uuugcacgugcuguuugcugugcguggaaugc

SEQ ID NO: 545931 - RNA, 32 nt, Human
uuugcacuaccagucucccaaauagaaaauca

SEQ ID NO: 545932 - RNA, 32 nt, Human
uuugcacuaccuguuaucaguagugccuuuac

SEQ ID NO: 545933 - RNA, 32 nt, Human
uuugcacuccugugagaaucuaaugccucugc

SEQ ID NO: 545934 - RNA, 32 nt, Human
uuugcacucuucuggccugccccauguuacua

SEQ ID NO: 545935 - RNA, 32 nt, Human
uuugcacugcaacaucaugccucugaagaaaa

SEQ ID NO: 545936 - RNA, 32 nt, Human
uuugcacuggcuucuuguuuaggcugaauccu

SEQ ID NO: 545937 - RNA, 32 nt, Human
uuugcacuuacugcugcguucccuucaucuaa

SEQ ID NO: 545938 - RNA, 32 nt, Human
uuugcacuuagguaccaggugucaggaaacag

SEQ ID NO: 545939 - RNA, 32 nt, Human
uuugcacuucauauuuguuuacuuucuccuaa

SEQ ID NO: 545940 - RNA, 32 nt, Human
uuugcagaaaugaucauuugcacagaaugggu

SEQ ID NO: 545941 - RNA, 32 nt, Human
uuugcagaacuguuguagaaagcugccuuaua

SEQ ID NO: 545942 - RNA, 32 nt, Human
uuugcagacaagggcuugggauggacccucag

SEQ ID NO: 545943 - RNA, 32 nt, Human
uuugcagacacagggucucaccauguugccca

SEQ ID NO: 545944 - RNA, 32 nt, Human
uuugcagaccgaacagugaaaagcuuucagug

SEQ ID NO: 545945 - RNA, 22 nt, Human
uuugcagacuacgucuccugcc

SEQ ID NO: 545946 - RNA, 32 nt, Human
uuugcagacuagaaaggugagccccagaaggg

SEQ ID NO: 545947 - RNA, 32 nt, Human
uuugcagacuugggguugggagaacaucuuaa

SEQ ID NO: 545948 - RNA, 32 nt, Human
uuugcagagaccacugcacuccagccugggca

SEQ ID NO: 545949 - RNA, 32 nt, Human
uuugcagaggcguaggaaugaggcuggacaga

SEQ ID NO: 545950 - RNA, 32 nt, Human
uuugcagaguccaugaaacaggaacacuccca

SEQ ID NO: 545951 - RNA, 21 nt, Human
uuugcagaucuugcuccuuuc

SEQ ID NO: 545952 - RNA, 32 nt, Human
uuugcagauggaccuuucccuaugggcacuau

SEQ ID NO: 545953 - RNA, 32 nt, Human
uuugcagauguaggugguuccagcuuuucuuu

SEQ ID NO: 545954 - RNA, 32 nt, Human
uuugcagcauugcacuccagccugggugacag

SEQ ID NO: 545955 - RNA, 32 nt, Human
uuugcagccaguucccaccaauaugccccaga

SEQ ID NO: 545956 - RNA, 32 nt, Human
uuugcagcccacuccccaucuuccugcuauaa

SEQ ID NO: 545957 - RNA, 32 nt, Human
uuugcagcccaggcuggagugcaguggcacca

SEQ ID NO: 545958 - RNA, 32 nt, Human
uuugcagcccaguccccgccuuuucagaggga

SEQ ID NO: 545959 - RNA, 18 nt, Human
uuugcagccccugcccca

SEQ ID NO: 545960 - RNA, 32 nt, Human
uuugcagcccugggugggggcaugagauagac

SEQ ID NO: 545961 - RNA, 32 nt, Human
uuugcagccuccucuucugucaccaacuggga

SEQ ID NO: 545962 - RNA, 32 nt, Human
uuugcagcuagggguggccgugucacagucug

SEQ ID NO: 545963 - RNA, 32 nt, Human
uuugcagcucugacuucugcucccaguaaccc

SEQ ID NO: 545964 - RNA, 32 nt, Human
uuugcagcuggggacauggaggcuagaagcau

SEQ ID NO: 545965 - RNA, 32 nt, Human
uuugcaggaaggccugaacaugugcacccucc

SEQ ID NO: 545966 - RNA, 32 nt, Human
uuugcaggacaguguucucaggagcugggccu

SEQ ID NO: 545967 - RNA, 32 nt, Human
uuugcaggacuggcccacacaguccccugcag

SEQ ID NO: 545968 - RNA, 32 nt, Human
uuugcaggagggccaggaagggguuccggcca

SEQ ID NO: 545969 - RNA, 32 nt, Human
uuugcaggauccgucugugcacaugccucugu

SEQ ID NO: 545970 - RNA, 25 nt, Human
uuugcaggccucaccucugccuucu

SEQ ID NO: 545971 - RNA, 32 nt, Human
uuugcaggcgggggucugagaucagggugucg

SEQ ID NO: 545972 - RNA, 24 nt, Human
uuugcaggcucugcugugucuuuc

SEQ ID NO: 545973 - RNA, 32 nt, Human
uuugcagggaaauugacugcaggugauagugu

SEQ ID NO: 545974 - RNA, 20 nt, Human
uuugcagggaagagggcccc

SEQ ID NO: 545975 - RNA, 32 nt, Human
uuugcagggcauagggcgauggggaagccaua

SEQ ID NO: 545976 - RNA, 32 nt, Human
uuugcaggggguggggguuggggaagacagca

SEQ ID NO: 545977 - RNA, 32 nt, Human
uuugcaggguuccuuucuguggggguaccugu

SEQ ID NO: 545978 - RNA, 22 nt, Human
uuugcaggucagccuccucucc

SEQ ID NO: 545979 - RNA, 32 nt, Human
uuugcaggucuuuauuucuucuguaaaacagu

SEQ ID NO: 545980 - RNA, 32 nt, Human
uuugcaggugcucacacuacacuuacaacuug

SEQ ID NO: 545981 - RNA, 32 nt, Human
uuugcagguguaacagauaaccagagaagcug

SEQ ID NO: 545982 - RNA, 32 nt, Human
uuugcaggugugagucaaugugggaacccagg

SEQ ID NO: 545983 - RNA, 32 nt, Human
uuugcaguccuccccuacccacucccugcccu

SEQ ID NO: 545984 - RNA, 32 nt, Human
uuugcaguccuccuguggcucaucccucggac

SEQ ID NO: 545985 - RNA, 32 nt, Human
uuugcagucucaggacgggcgcuuuggagccg

SEQ ID NO: 545986 - RNA, 32 nt, Human
uuugcagucucccccaguguggugugacuggc

SEQ ID NO: 545987 - RNA, 32 nt, Human
uuugcagucuccucucagucauucaucaaugu

SEQ ID NO: 545988 - RNA, 32 nt, Human
uuugcagucuguuucaagauuucugcauccac

SEQ ID NO: 545989 - RNA, 32 nt, Human
uuugcagucuuuucaaugcagccacauuuuua

SEQ ID NO: 545990 - RNA, 32 nt, Human
uuugcagugagcugagauugcgcuacuacgcu

SEQ ID NO: 545991 - RNA, 32 nt, Human
uuugcaguggguggaguuguggauagggguga

SEQ ID NO: 545992 - RNA, 32 nt, Human
uuugcaguuacucaucugagacagcaucagua

SEQ ID NO: 545993 - RNA, 32 nt, Human
uuugcaguucugcccuccaccuugcuaucugc

SEQ ID NO: 545994 - RNA, 32 nt, Human
uuugcaguugcagacgucugugccuagcaaua

SEQ ID NO: 545995 - RNA, 32 nt, Human
uuugcauaagaaaggcuuuucucuccagucau

SEQ ID NO: 545996 - RNA, 32 nt, Human
uuugcauaguaagcgccaggcuuugccaucga

SEQ ID NO: 545997 - RNA, 32 nt, Human
uuugcauaguauagggacuugaaaguuuuaug

SEQ ID NO: 545998 - RNA, 32 nt, Human
uuugcauaucacccuucccugcucccaccacc

SEQ ID NO: 545999 - RNA, 32 nt, Human
uuugcaucaagaaaaagcaccucucuucaccu

SEQ ID NO: 546000 - RNA, 32 nt, Human
uuugcaucacugcacuccagccugggcaacag

SEQ ID NO: 546001 - RNA, 32 nt, Human
uuugcaucacugcacuccagccugggcagcag

SEQ ID NO: 546002 - RNA, 22 nt, Human
uuugcaucagcagugguagaag

SEQ ID NO: 546003 - RNA, 32 nt, Human
uuugcaucauuuccccucucuggcuccaauuu

SEQ ID NO: 546004 - RNA, 32 nt, Human
uuugcaucuccaggcaguucucucacauuugg

SEQ ID NO: 546005 - RNA, 32 nt, Human
uuugcaugaaucacaaagcagaaugguaccuu

SEQ ID NO: 546006 - RNA, 32 nt, Human
uuugcaugaauuugaagaacacaggcuuguac

SEQ ID NO: 546007 - RNA, 30 nt, Human
uuugcaugacacagcaagcccagugucccc

SEQ ID NO: 546008 - RNA, 21 nt, Human
uuugcaugccugaauauucuc

SEQ ID NO: 546009 - RNA, 32 nt, Human
uuugcaugcuaaaauucucccggccucauccu

SEQ ID NO: 546010 - RNA, 32 nt, Human
uuugcauggauggaugcaugcauugccuaguc

SEQ ID NO: 546011 - RNA, 32 nt, Human
uuugcaugggaggcagguggggcuuggaucag

SEQ ID NO: 546012 - RNA, 32 nt, Human
uuugcauggguuuucugggaaauuaggauaac

SEQ ID NO: 546013 - RNA, 32 nt, Human
uuugcaugucaaaucacauugaagccugaaga

SEQ ID NO: 546014 - RNA, 32 nt, Human
uuugcaugugcaaaugugcuggucacccuuca

SEQ ID NO: 546015 - RNA, 23 nt, Human
uuugcauguucuaaaguugugua

SEQ ID NO: 546016 - RNA, 32 nt, Human
uuugcauuaaaauagcaaaaucugccgggcau

SEQ ID NO: 546017 - RNA, 32 nt, Human
uuugcauuacuguaugucuucugccuccacac

SEQ ID NO: 546018 - RNA, 27 nt, Human
uuugcauucugcagguuuuccauuuua

SEQ ID NO: 546019 - RNA, 32 nt, Human
uuugcauuucccccuccuccagccucuguagg

SEQ ID NO: 546020 - RNA, 32 nt, Human
uuugcauuugcauuuaucucuccugagcaucc

SEQ ID NO: 546021 - RNA, 32 nt, Human
uuugcauuuggguaaaauaaagugaccaugcu

SEQ ID NO: 546022 - RNA, 21 nt, Human
uuugcauuuuaaaacucugua

SEQ ID NO: 546023 - RNA, 32 nt, Human
uuugcauuuuccacucaugcagcugguucuau

SEQ ID NO: 546024 - RNA, 32 nt, Human
uuugccaaagagaguaauccuggaaccaaguu

SEQ ID NO: 546025 - RNA, 32 nt, Human
uuugccaaauaacaaaagcauacaaugcauac

SEQ ID NO: 546026 - RNA, 32 nt, Human
uuugccaacauggugaaacuccaucucuacug

SEQ ID NO: 546027 - RNA, 32 nt, Human
uuugccaagaugcuagucacacaccaaguaca

SEQ ID NO: 546028 - RNA, 32 nt, Human
uuugccaagggagagacaugaagacagaggag

SEQ ID NO: 546029 - RNA, 32 nt, Human
uuugccaagggaggcggauuucccugguagug

SEQ ID NO: 546030 - RNA, 32 nt, Human
uuugccaagucuucuguaaagaugucuaggac

SEQ ID NO: 546031 - RNA, 32 nt, Human
uuugccaaguguuuuuacaucaucucauuuga

SEQ ID NO: 546032 - RNA, 32 nt, Human
uuugccaaugaagaaauggucuguagguauuu

SEQ ID NO: 546033 - RNA, 32 nt, Human
uuugccacaaaaccuguauuacugaauaauau

SEQ ID NO: 546034 - RNA, 32 nt, Human
uuugccacaagagauccuuucagucccuagac

SEQ ID NO: 546035 - RNA, 32 nt, Human
uuugccacaguguggagcagauuuucucacug

SEQ ID NO: 546036 - RNA, 32 nt, Human
uuugccaccacugcaagcaaaagucuggagaa

SEQ ID NO: 546037 - RNA, 32 nt, Human
uuugccaccaucuccuccucugaucuccuuuc

SEQ ID NO: 546038 - RNA, 32 nt, Human
uuugccacccaugccucuucaggcuggaaaua

SEQ ID NO: 546039 - RNA, 32 nt, Human
uuugccacguucuaaauaauauuuagcucaac

SEQ ID NO: 546040 - RNA, 32 nt, Human
uuugccacucgccucuaucuuugaaucauauu

SEQ ID NO: 546041 - RNA, 32 nt, Human
uuugccacugacuucucccacccuucugucuc

SEQ ID NO: 546042 - RNA, 32 nt, Human
uuugccacugaggaguuggagggagggcaaga

SEQ ID NO: 546043 - RNA, 32 nt, Human
uuugccacugcacuccugccugggugacagaa

SEQ ID NO: 546044 - RNA, 32 nt, Human
uuugccacuuaacuccaguguggaugacagag

SEQ ID NO: 546045 - RNA, 32 nt, Human
uuugccacuuucccccucacauugauuaaggu

SEQ ID NO: 546046 - RNA, 32 nt, Human
uuugccagacaaguggagauuuuugcagcuca

SEQ ID NO: 546047 - RNA, 32 nt, Human
uuugccagagcacccuccuucaguccuccgau

SEQ ID NO: 546048 - RNA, 32 nt, Human
uuugccagaggaccaaugcuugcauggagaau

SEQ ID NO: 546049 - RNA, 32 nt, Human
uuugccagauagccucugucugccuagugaga

SEQ ID NO: 546050 - RNA, 32 nt, Human
uuugccagccuccaccuucuaacccuccuaga

SEQ ID NO: 546051 - RNA, 32 nt, Human
uuugccagccuggcaacagagcaagacucugu

SEQ ID NO: 546052 - RNA, 32 nt, Human
uuugccagcuccauacauguuggggccugagg

SEQ ID NO: 546053 - RNA, 32 nt, Human
uuugccaguaaaccaaaaagcagauccuugaa

SEQ ID NO: 546054 - RNA, 32 nt, Human
uuugccagugccauguccagguggugagguau

SEQ ID NO: 546055 - RNA, 32 nt, Human
uuugccaguggaaucugcugggccagucccua

SEQ ID NO: 546056 - RNA, 32 nt, Human
uuugccaguuauuuuuauugucuuuuacuuuu

SEQ ID NO: 546057 - RNA, 32 nt, Human
uuugccaucaccaguuucucaggcuggggagc

SEQ ID NO: 546058 - RNA, 32 nt, Human
uuugccaucgccaaggaguaggcacagggaca

SEQ ID NO: 546059 - RNA, 32 nt, Human
uuugccaucuaugccagcauuuuuaccuucaa

SEQ ID NO: 546060 - RNA, 32 nt, Human
uuugccaucuccugcacagccugggggagcua

SEQ ID NO: 546061 - RNA, 32 nt, Human
uuugccaugacugcucugggccggggguagag

SEQ ID NO: 546062 - RNA, 32 nt, Human
uuugccaugcaggaacaugagcaauacagaag

SEQ ID NO: 546063 - RNA, 32 nt, Human
uuugccauggagagaauagcaucucuauucca

SEQ ID NO: 546064 - RNA, 32 nt, Human
uuugccauguugcccaggcuggucugaagcug

SEQ ID NO: 546065 - RNA, 32 nt, Human
uuugccauguuggccaggcuggucuagaacuc

SEQ ID NO: 546066 - RNA, 32 nt, Human
uuugccauuacuagccagcugugggcucuuca

SEQ ID NO: 546067 - RNA, 32 nt, Human
uuugcccaagagaaagacuagaaggacuaaaa

SEQ ID NO: 546068 - RNA, 32 nt, Human
uuugcccaauaaaggaauuacagggaaaaaga

SEQ ID NO: 546069 - RNA, 32 nt, Human
uuugcccacccugcccucucucccucugccuu

SEQ ID NO: 546070 - RNA, 32 nt, Human
uuugcccacguguccugaggggcugcuugucu

SEQ ID NO: 546071 - RNA, 32 nt, Human
uuugcccacugcacacuugcuguguacaauga

SEQ ID NO: 546072 - RNA, 32 nt, Human
uuugcccagcuuucugucuggggcgcacggag

SEQ ID NO: 546073 - RNA, 23 nt, Human
uuugcccaggccggagugcaaug

SEQ ID NO: 546074 - RNA, 23 nt, Human
uuugcccaggcuggagcgaagug

SEQ ID NO: 546075 - RNA, 23 nt, Human
uuugcccaggcuggagugcagug

SEQ ID NO: 546076 - RNA, 24 nt, Human
uuugcccaggcuggagugcagugg

SEQ ID NO: 546077 - RNA, 32 nt, Human
uuugcccaggcuggauggagugcaguggcgug

SEQ ID NO: 546078 - RNA, 32 nt, Human
uuugcccauagucuugaaugcaauauuuguuu

SEQ ID NO: 546079 - RNA, 32 nt, Human
uuugccccaagaaguguuuggauaaccacaca

SEQ ID NO: 546080 - RNA, 32 nt, Human
uuugccccaccaccaccuccucgggcuucauu

SEQ ID NO: 546081 - RNA, 32 nt, Human
uuugccccagguguuugugagcagguugggau

SEQ ID NO: 546082 - RNA, 32 nt, Human
uuugccccaguucugggcagccacaggccccc

SEQ ID NO: 546083 - RNA, 32 nt, Human
uuugccccauuuccuaucucuagcaaccuccu

SEQ ID NO: 546084 - RNA, 32 nt, Human
uuugcccccaacaaagagaaggggucuugcuc

SEQ ID NO: 546085 - RNA, 32 nt, Human
uuugcccccugggccaggcagagcaggcgcug

SEQ ID NO: 546086 - RNA, 32 nt, Human
uuugccccgaaugagagguugaggaaaagacu

SEQ ID NO: 546087 - RNA, 32 nt, Human
uuugccccgcugcucugcuccgcccauaagag

SEQ ID NO: 546088 - RNA, 32 nt, Human
uuugccccuccccaucacaguccugcccuuca

SEQ ID NO: 546089 - RNA, 32 nt, Human
uuugccccucggccgggagcggcuagccggga

SEQ ID NO: 546090 - RNA, 31 nt, Human
uuugccccugaagucaguuucaggggaagga

SEQ ID NO: 546091 - RNA, 32 nt, Human
uuugccccugaguugugucaggagauuugagg

SEQ ID NO: 546092 - RNA, 32 nt, Human
uuugccccuggcaaaugcacacaccucaugcu

SEQ ID NO: 546093 - RNA, 32 nt, Human
uuugccccuggcaaaugcauacaccucaugcu

SEQ ID NO: 546094 - RNA, 32 nt, Human
uuugccccuucccaucucuuccuacccaacca

SEQ ID NO: 546095 - RNA, 32 nt, Human
uuugcccgagacugaaggauuucucaggcugu

SEQ ID NO: 546096 - RNA, 32 nt, Human
uuugcccuaaaauuaaaggugucaaagagggg

SEQ ID NO: 546097 - RNA, 21 nt, Human
uuugcccucagugccagccaa

SEQ ID NO: 546098 - RNA, 32 nt, Human
uuugcccucccaggacccugagguugcuuuau

SEQ ID NO: 546099 - RNA, 19 nt, Human
uuugcccuccgcaggagcc

SEQ ID NO: 546100 - RNA, 32 nt, Human
uuugcccucucgccuccuccuccugggaagaa

SEQ ID NO: 546101 - RNA, 32 nt, Human
uuugcccucucuugacuccagccuagggaaug

SEQ ID NO: 546102 - RNA, 20 nt, Human
uuugcccucugcugucacca

SEQ ID NO: 546103 - RNA, 32 nt, Human
uuugcccucuuuccuucucuucuccucacagc

SEQ ID NO: 546104 - RNA, 32 nt, Human
uuugcccugaagaugcuggcagagcaggaugu

SEQ ID NO: 546105 - RNA, 32 nt, Human
uuugcccugaguccaagaggguccuuuaguac

SEQ ID NO: 546106 - RNA, 32 nt, Human
uuugcccugcagcaauucaccugccuuuccuu

SEQ ID NO: 546107 - RNA, 32 nt, Human
uuugcccugccugucucacaggccugcuguga

SEQ ID NO: 546108 - RNA, 32 nt, Human
uuugcccugcuccucaccuccuggcccugcuc

SEQ ID NO: 546109 - RNA, 32 nt, Human
uuugcccugcugugugugccucuguagcuccu

SEQ ID NO: 546110 - RNA, 32 nt, Human
uuugcccuguugguaaggauuuuaaauaacca

SEQ ID NO: 546111 - RNA, 25 nt, Human
uuugcccuuccuccugccuuucuca

SEQ ID NO: 546112 - RNA, 32 nt, Human
uuugcccuuccuuucuuuaaagcuauucucac

SEQ ID NO: 546113 - RNA, 32 nt, Human
uuugcccuucuuucuacccugcuggggaaagu

SEQ ID NO: 546114 - RNA, 24 nt, Human
uuugcccuuuagggcuguugcuag

SEQ ID NO: 546115 - RNA, 32 nt, Human
uuugcccuuuccaacggcuauggcaucagguu

SEQ ID NO: 546116 - RNA, 32 nt, Human
uuugcccuuuccaacucuagacuauugauucc

SEQ ID NO: 546117 - RNA, 32 nt, Human
uuugcccuuuguccuguucccucagaagcaug

SEQ ID NO: 546118 - RNA, 19 nt, Human
uuugccgccugcaaggcgg

SEQ ID NO: 546119 - RNA, 32 nt, Human
uuugccgcgggugugugaagggagacagugug

SEQ ID NO: 546120 - RNA, 32 nt, Human
uuugccgcuagucccugugaagcucugccagg

SEQ ID NO: 546121 - RNA, 32 nt, Human
uuugccguacuuccuagaagcacuggaagagg

SEQ ID NO: 546122 - RNA, 32 nt, Human
uuugccguagaaacuccagcugucacugcggg

SEQ ID NO: 546123 - RNA, 32 nt, Human
uuugccguccccuggccaggaugguggagucu

SEQ ID NO: 546124 - RNA, 32 nt, Human
uuugccgucugcgcuccagccuucgccuggca

SEQ ID NO: 546125 - RNA, 32 nt, Human
uuugccuacucuuugccccagcaauuccucgu

SEQ ID NO: 546126 - RNA, 32 nt, Human
uuugccuagaauccuguucucuucugaauuug

SEQ ID NO: 546127 - RNA, 32 nt, Human
uuugccuagcagagaaggaccacaaaggaacu

SEQ ID NO: 546128 - RNA, 32 nt, Human
uuugccucaaagccaucccccaccagacugcu

SEQ ID NO: 546129 - RNA, 32 nt, Human
uuugccucaagcaaccucuagcucccacaauu

SEQ ID NO: 546130 - RNA, 32 nt, Human
uuugccucagaaccucuccuucaggagcacuu

SEQ ID NO: 546131 - RNA, 32 nt, Human
uuugccucauuuucucuuuuuguucacaagag

SEQ ID NO: 546132 - RNA, 32 nt, Human
uuugccuccagcugccucagucucuucaugug

SEQ ID NO: 546133 - RNA, 32 nt, Human
uuugccuccauccuuuucucacagcaaugaau

SEQ ID NO: 546134 - RNA, 32 nt, Human
uuugccucccaaagugcugggauuacaagcau

SEQ ID NO: 546135 - RNA, 32 nt, Human
uuugccucccaaagugcugggauuacaggcau

SEQ ID NO: 546136 - RNA, 32 nt, Human
uuugccucccaaagugcugggauuacaggcgu

SEQ ID NO: 546137 - RNA, 32 nt, Human
uuugccucccaccaugauucugaggccuccuc

SEQ ID NO: 546138 - RNA, 32 nt, Human
uuugccucccaccaugauucugaggcuuuccc

SEQ ID NO: 546139 - RNA, 32 nt, Human
uuugccucccacguugggaagucauuaguuga

SEQ ID NO: 546140 - RNA, 32 nt, Human
uuugccucccgaguagcugggauuacaggcac

SEQ ID NO: 546141 - RNA, 32 nt, Human
uuugccucccucucuucucuuugccuguaugc

SEQ ID NO: 546142 - RNA, 32 nt, Human
uuugccucucugaggcagacaggaagugucua

SEQ ID NO: 546143 - RNA, 32 nt, Human
uuugccucugaaggagcuucagcgccagccag

SEQ ID NO: 546144 - RNA, 32 nt, Human
uuugccucuuagguaagugagugcaguaaaga

SEQ ID NO: 546145 - RNA, 32 nt, Human
uuugccucuugggagcuuaugggucuaugagg

SEQ ID NO: 546146 - RNA, 32 nt, Human
uuugccucuuuccugagccucuugcuugaaug

SEQ ID NO: 546147 - RNA, 32 nt, Human
uuugccugaacacccauguagcugcuguguug

SEQ ID NO: 546148 - RNA, 32 nt, Human
uuugccugcacucuugccugcugcccugagca

SEQ ID NO: 546149 - RNA, 32 nt, Human
uuugccugccuucccuucauccuauccucuuu

SEQ ID NO: 546150 - RNA, 32 nt, Human
uuugccugcggucccagcuacuugggaagcug

SEQ ID NO: 546151 - RNA, 32 nt, Human
uuugccugcuucuuuccagaaaccaaacuagg

SEQ ID NO: 546152 - RNA, 32 nt, Human
uuugccuggcuaaaagagucucucucuaagua

SEQ ID NO: 546153 - RNA, 32 nt, Human
uuugccugggagaggcccugguggccucguuc

SEQ ID NO: 546154 - RNA, 32 nt, Human
uuugccugggugcugggccugccuucucuggc

SEQ ID NO: 546155 - RNA, 32 nt, Human
uuugccuggucccucuagcugcuggugguucu

SEQ ID NO: 546156 - RNA, 32 nt, Human
uuugccuguccguccuucccagaagagacaca

SEQ ID NO: 546157 - RNA, 15 nt, Human
uuugccugugccaug

SEQ ID NO: 546158 - RNA, 32 nt, Human
uuugccuguggauaagaugaccuguguaauaa

SEQ ID NO: 546159 - RNA, 32 nt, Human
uuugccuguggaucuguuuggccagggucccu

SEQ ID NO: 546160 - RNA, 32 nt, Human
uuugccuguuacugcugucuagacgccuucca

SEQ ID NO: 546161 - RNA, 32 nt, Human
uuugccuuacuuuugcccucucccauuuucug

SEQ ID NO: 546162 - RNA, 32 nt, Human
uuugccuuauaacugacauuucuucaaauuau

SEQ ID NO: 546163 - RNA, 32 nt, Human
uuugccuucagagagccccggggaggcugcaa

SEQ ID NO: 546164 - RNA, 32 nt, Human
uuugccuucaugcugguuuaccccaaagaguu

SEQ ID NO: 546165 - RNA, 32 nt, Human
uuugccuuccaacugccagaacauggauucca

SEQ ID NO: 546166 - RNA, 32 nt, Human
uuugccuuccaggggaccuuugcagugccugg

SEQ ID NO: 546167 - RNA, 32 nt, Human
uuugccuuccauuuuucuggguaauguccuuu

SEQ ID NO: 546168 - RNA, 32 nt, Human
uuugccuucccuaccucuuccucccagagucc

SEQ ID NO: 546169 - RNA, 32 nt, Human
uuugccuucggacuucuccggggccagcagcc

SEQ ID NO: 546170 - RNA, 32 nt, Human
uuugccuucucccugggaacugguucaagaga

SEQ ID NO: 546171 - RNA, 32 nt, Human
uuugccuucuugaugccagccugcugcaacag

SEQ ID NO: 546172 - RNA, 32 nt, Human
uuugccuugcagccacauggccccaucccagu

SEQ ID NO: 546173 - RNA, 32 nt, Human
uuugccuugcuuagagaauuacugcaaaucag

SEQ ID NO: 546174 - RNA, 32 nt, Human
uuugccuuggcuuagaggcugcagcacuucau

SEQ ID NO: 546175 - RNA, 32 nt, Human
uuugccuugguaggaauucuguucuguguugu

SEQ ID NO: 546176 - RNA, 32 nt, Human
uuugccuuguccucauuacugccaucaggaag

SEQ ID NO: 546177 - RNA, 32 nt, Human
uuugccuuguuuguuaguuugccugggucugu

SEQ ID NO: 546178 - RNA, 32 nt, Human
uuugccuuucccugguuuucuucaccaagccc

SEQ ID NO: 546179 - RNA, 32 nt, Human
uuugccuuuccuuugccacccucucccuguuu

SEQ ID NO: 546180 - RNA, 32 nt, Human
uuugccuuugagauguguuucuuucugccucc

SEQ ID NO: 546181 - RNA, 32 nt, Human
uuugccuuuguuugcacuguguguucagugaa

SEQ ID NO: 546182 - RNA, 32 nt, Human
uuugccuuuucugccauuuuaauuuuccauuu

SEQ ID NO: 546183 - RNA, 24 nt, Human
uuugcgaccagccugggcagaaua

SEQ ID NO: 546184 - RNA, 32 nt, Human
uuugcgaccagccugggcagaauagcaagacc

SEQ ID NO: 546185 - RNA, 32 nt, Human
uuugcgaccagccuggucaacauaguggaccc

SEQ ID NO: 546186 - RNA, 32 nt, Human
uuugcgaccccgagucccaugacaccgcuucu

SEQ ID NO: 546187 - RNA, 32 nt, Human
uuugcgcacaccauggcggccccugcccagca

SEQ ID NO: 546188 - RNA, 32 nt, Human
uuugcgccacugcauucuagccugagugacag

SEQ ID NO: 546189 - RNA, 32 nt, Human
uuugcgcuagcuuggaaaaugauugagaucaa

SEQ ID NO: 546190 - RNA, 31 nt, Human
uuugcgcuguuucagccuccugauucaacuc

SEQ ID NO: 546191 - RNA, 32 nt, Human
uuugcgcuuggaagcaggggaagcauucagau

SEQ ID NO: 546192 - RNA, 32 nt, Human
uuugcgcuuggugaagagaagcccccaccucc

SEQ ID NO: 546193 - RNA, 32 nt, Human
uuugcggauacuuugcuuauucguuuaacgac

SEQ ID NO: 546194 - RNA, 23 nt, Human
uuugcggaucggucacuuuuucc

SEQ ID NO: 546195 - RNA, 32 nt, Human
uuugcggggagagaggucagagccagaugaaa

SEQ ID NO: 546196 - RNA, 32 nt, Human
uuugcggggccugucucagugauucgcuuuug

SEQ ID NO: 546197 - RNA, 32 nt, Human
uuugcggugauaaccuucucuggcagagugac

SEQ ID NO: 546198 - RNA, 32 nt, Human
uuugcgguuaaccugaauucacugaacuggga

SEQ ID NO: 546199 - RNA, 32 nt, Human
uuugcgucugaagccuuucuccuuuucuguca

SEQ ID NO: 546200 - RNA, 32 nt, Human
uuugcgucuggcuucucuauugaauucuuaaa

SEQ ID NO: 546201 - RNA, 32 nt, Human
uuugcgugcaucagaaucacccagaaagaugu

SEQ ID NO: 546202 - RNA, 32 nt, Human
uuugcgugccugacagccuggcuagcacagga

SEQ ID NO: 546203 - RNA, 32 nt, Human
uuugcgugugugugcgugcgcaugugcuuccg

SEQ ID NO: 546204 - RNA, 32 nt, Human
uuugcguucuccccugccguccuucaacugua

SEQ ID NO: 546205 - RNA, 32 nt, Human
uuugcuaaaauuacguuaagaauguuugcauu

SEQ ID NO: 546206 - RNA, 32 nt, Human
uuugcuaaaccucuccucugacugccuuuauu

SEQ ID NO: 546207 - RNA, 32 nt, Human
uuugcuaacuauagauguccuuuaacaaaauu

SEQ ID NO: 546208 - RNA, 32 nt, Human
uuugcuaagacucaaacggcuugagugcagca

SEQ ID NO: 546209 - RNA, 32 nt, Human
uuugcuaauaugaauggugcugugaggaacau

SEQ ID NO: 546210 - RNA, 32 nt, Human
uuugcuaauguuccagcaacacugcuauuaua

SEQ ID NO: 546211 - RNA, 32 nt, Human
uuugcuacacuucuccccaccugguacaugau

SEQ ID NO: 546212 - RNA, 32 nt, Human
uuugcuaccaggacaggcucucgacagggcau

SEQ ID NO: 546213 - RNA, 32 nt, Human
uuugcuaccauuuugacccauuauucccuuac

SEQ ID NO: 546214 - RNA, 32 nt, Human
uuugcuacuguacauaaacaaugaugcccugc

SEQ ID NO: 546215 - RNA, 32 nt, Human
uuugcuacuuuuacuuucaucuuccucugcug

SEQ ID NO: 546216 - RNA, 32 nt, Human
uuugcuagaagaguggucaagggaaaaacgag

SEQ ID NO: 546217 - RNA, 32 nt, Human
uuugcuagaaggacucacuagacucaggaaag

SEQ ID NO: 546218 - RNA, 32 nt, Human
uuugcuagauggagucuugcucugucaccagg

SEQ ID NO: 546219 - RNA, 30 nt, Human
uuugcuagccucuucauaugcuguugcaua

SEQ ID NO: 546220 - RNA, 32 nt, Human
uuugcuagucagacaagugacagggaauggau

SEQ ID NO: 546221 - RNA, 32 nt, Human
uuugcuauauguuuugcuauuuccuuguggcu

SEQ ID NO: 546222 - RNA, 32 nt, Human
uuugcuauugaauuggccagcucugcuugcug

SEQ ID NO: 546223 - RNA, 32 nt, Human
uuugcuauuucuuuucuugcuggagccucacc

SEQ ID NO: 546224 - RNA, 32 nt, Human
uuugcucacagcaauucuccuucuacagagga

SEQ ID NO: 546225 - RNA, 32 nt, Human
uuugcucacaugcaagacacauacagcccuau

SEQ ID NO: 546226 - RNA, 32 nt, Human
uuugcucacuauccccagccucaaggagccaa

SEQ ID NO: 546227 - RNA, 32 nt, Human
uuugcucacugcaacauccaccucaugggcuc

SEQ ID NO: 546228 - RNA, 32 nt, Human
uuugcucacuucugccaagaacacagaacuac

SEQ ID NO: 546229 - RNA, 32 nt, Human
uuugcucagacacacauauucuuucucccaau

SEQ ID NO: 546230 - RNA, 32 nt, Human
uuugcucauauucacauauguaaaccagaaca

SEQ ID NO: 546231 - RNA, 32 nt, Human
uuugcucaugccaugcccucagccuggaaugc

SEQ ID NO: 546232 - RNA, 32 nt, Human
uuugcuccaaauuccuccucugcguccaggag

SEQ ID NO: 546233 - RNA, 32 nt, Human
uuugcucccaggcuggaaugcaguggcuauuc

SEQ ID NO: 546234 - RNA, 32 nt, Human
uuugcucccuccaaucuugagauuggguuuug

SEQ ID NO: 546235 - RNA, 32 nt, Human
uuugcucccuuuuucuuuuucuccccuuccuc

SEQ ID NO: 546236 - RNA, 32 nt, Human
uuugcuccuaauggcucucugaaagugacaga

SEQ ID NO: 546237 - RNA, 32 nt, Human
uuugcuccuauuugugaacauucaaagccugc

SEQ ID NO: 546238 - RNA, 32 nt, Human
uuugcuccuguuccccucacagcuccagacau

SEQ ID NO: 546239 - RNA, 32 nt, Human
uuugcuccuguugccgcccucaucucagagaa

SEQ ID NO: 546240 - RNA, 32 nt, Human
uuugcucgaugcagacagggggccagaacacc

SEQ ID NO: 546241 - RNA, 32 nt, Human
uuugcucguuugggguguaaagugccaugacu

SEQ ID NO: 546242 - RNA, 32 nt, Human
uuugcucuccaccuccugccucugcuuauuuc

SEQ ID NO: 546243 - RNA, 32 nt, Human
uuugcucuccaggacaucagcacauggcccug

SEQ ID NO: 546244 - RNA, 32 nt, Human
uuugcucucccaggccccuggcuguccauguc

SEQ ID NO: 546245 - RNA, 22 nt, Human
uuugcucucccgcuguugccag

SEQ ID NO: 546246 - RNA, 32 nt, Human
uuugcucucccucccuucuuuccuuccuuuuu

SEQ ID NO: 546247 - RNA, 22 nt, Human
uuugcucucugguguuuguuaa

SEQ ID NO: 546248 - RNA, 32 nt, Human
uuugcucucuuuaagaccucacagauucugac

SEQ ID NO: 546249 - RNA, 32 nt, Human
uuugcucugcuacuugagaugauggagagcag

SEQ ID NO: 546250 - RNA, 32 nt, Human
uuugcucugucacccaggcuggaguacacugg

SEQ ID NO: 546251 - RNA, 32 nt, Human
uuugcucugucacccaggcuggagugaggugg

SEQ ID NO: 546252 - RNA, 32 nt, Human
uuugcucugucacccaggcuggagugcagugg

SEQ ID NO: 546253 - RNA, 32 nt, Human
uuugcucugucgcccaggcugcaaccucgacc

SEQ ID NO: 546254 - RNA, 32 nt, Human
uuugcucuguugcccaggcuggagugcagugg

SEQ ID NO: 546255 - RNA, 32 nt, Human
uuugcucuuaacuccaagucugcccuucuuuu

SEQ ID NO: 546256 - RNA, 32 nt, Human
uuugcucuuacccaggcugagugcaguggcag

SEQ ID NO: 546257 - RNA, 32 nt, Human
uuugcucuuacuacacugaggagagauucccg

SEQ ID NO: 546258 - RNA, 32 nt, Human
uuugcucuugcacuccauccuggacaacagag

SEQ ID NO: 546259 - RNA, 32 nt, Human
uuugcucuugccgaaaagaugagccucgauuu

SEQ ID NO: 546260 - RNA, 32 nt, Human
uuugcucuuggguggaggagacgaggggaggg

SEQ ID NO: 546261 - RNA, 32 nt, Human
uuugcugaaaauacaaaauuagccaggcgugg

SEQ ID NO: 546262 - RNA, 32 nt, Human
uuugcugaagaaauuguauuucaaccacaucc

SEQ ID NO: 546263 - RNA, 32 nt, Human
uuugcugacagcaggugcauuccugcuucccu

SEQ ID NO: 546264 - RNA, 32 nt, Human
uuugcugacagcugccaagaaaaugcuucacu

SEQ ID NO: 546265 - RNA, 32 nt, Human
uuugcugacuuacugaggauuaauuguugccu

SEQ ID NO: 546266 - RNA, 32 nt, Human
uuugcugagaaauaaaaaucaaaacuucuuua

SEQ ID NO: 546267 - RNA, 32 nt, Human
uuugcugagaauuuuggaaaugaagcaugugg

SEQ ID NO: 546268 - RNA, 32 nt, Human
uuugcugaugucuguaagaacucugucuaagc

SEQ ID NO: 546269 - RNA, 32 nt, Human
uuugcugauguucuuccaacucaguugaguga

SEQ ID NO: 546270 - RNA, 32 nt, Human
uuugcugauuauucaaccacagagccuuaugc

SEQ ID NO: 546271 - RNA, 32 nt, Human
uuugcugcaccuauugaccuauccugguaaau

SEQ ID NO: 546272 - RNA, 32 nt, Human
uuugcugcagaaaauuccaaaagauugcugua

SEQ ID NO: 546273 - RNA, 32 nt, Human
uuugcugcagcagccgcuggagggggcagagg

SEQ ID NO: 546274 - RNA, 32 nt, Human
uuugcugcagucuucucucuggcucaggugug

SEQ ID NO: 546275 - RNA, 32 nt, Human
uuugcugcaguuggagaagaaacugaauuuga

SEQ ID NO: 546276 - RNA, 32 nt, Human
uuugcugccacaccugagccagccugcuccuu

SEQ ID NO: 546277 - RNA, 32 nt, Human
uuugcugccaucuuccucaucauaaagugugg

SEQ ID NO: 546278 - RNA, 32 nt, Human
uuugcugccccagcuacuaaggugcuaggaau

SEQ ID NO: 546279 - RNA, 32 nt, Human
uuugcugccccucuccccuaccuggcccauuc

SEQ ID NO: 546280 - RNA, 32 nt, Human
uuugcugcccucuuugccccagagcugaagag

SEQ ID NO: 546281 - RNA, 32 nt, Human
uuugcugccguugggggcucaggcugcacucc

SEQ ID NO: 546282 - RNA, 32 nt, Human
uuugcugccuuccuggccagccagguggaaga

SEQ ID NO: 546283 - RNA, 32 nt, Human
uuugcugcuaagaaggcgugcccaguggggua

SEQ ID NO: 546284 - RNA, 32 nt, Human
uuugcugcuacuucuguggaaguagcuuugaa

SEQ ID NO: 546285 - RNA, 32 nt, Human
uuugcugcuaggaaggcgugcccaguggggua

SEQ ID NO: 546286 - RNA, 32 nt, Human
uuugcugcucacugagaacccagcuuugaacu

SEQ ID NO: 546287 - RNA, 31 nt, Human
uuugcugcucacuucugacagccagacaagg

SEQ ID NO: 546288 - RNA, 32 nt, Human
uuugcugcucacuucugacagccagacaaggg

SEQ ID NO: 546289 - RNA, 32 nt, Human
uuugcugcugagcuggaagcugugggggaagg

SEQ ID NO: 546290 - RNA, 32 nt, Human
uuugcugcuggggaggcuggaagcauauuccc

SEQ ID NO: 546291 - RNA, 23 nt, Human
uuugcugcuuccugucucugcca

SEQ ID NO: 546292 - RNA, 32 nt, Human
uuugcugcuuugcauccucuccaggcucugga

SEQ ID NO: 546293 - RNA, 32 nt, Human
uuugcugcuuuuauuuucuuccaagccaauca

SEQ ID NO: 546294 - RNA, 32 nt, Human
uuugcuggaugguuccuuuaugcagcuuggcc

SEQ ID NO: 546295 - RNA, 32 nt, Human
uuugcuggcacacacccucaagggugguucag

SEQ ID NO: 546296 - RNA, 32 nt, Human
uuugcugggcacuaugcuaagcacuuugggag

SEQ ID NO: 546297 - RNA, 32 nt, Human
uuugcugggcucuccagagcugggcuuggcuc

SEQ ID NO: 546298 - RNA, 32 nt, Human
uuugcuggggccaacaccagccuaaguggaga

SEQ ID NO: 546299 - RNA, 32 nt, Human
uuugcugggggagggugugagcacggaguauu

SEQ ID NO: 546300 - RNA, 32 nt, Human
uuugcuggguaugggaguuuaagcccggcaga

SEQ ID NO: 546301 - RNA, 32 nt, Human
uuugcuggguccaucacagaagagucucuaca

SEQ ID NO: 546302 - RNA, 32 nt, Human
uuugcuggguguggaaagaguugcuauggcca

SEQ ID NO: 546303 - RNA, 32 nt, Human
uuugcuggucucaaacuccugaccucggguga

SEQ ID NO: 546304 - RNA, 32 nt, Human
uuugcuguccucucugugaugacuuguugcug

SEQ ID NO: 546305 - RNA, 32 nt, Human
uuugcuguccuuccucuccuucgaagaugaca

SEQ ID NO: 546306 - RNA, 32 nt, Human
uuugcugucugcagauggcuugagugcuaauc

SEQ ID NO: 546307 - RNA, 32 nt, Human
uuugcugucuucccucucccucaggccauacu

SEQ ID NO: 546308 - RNA, 32 nt, Human
uuugcugugccaacagggaggacagggccugg

SEQ ID NO: 546309 - RNA, 32 nt, Human
uuugcuguggauucagaagcaccaggagcaag

SEQ ID NO: 546310 - RNA, 32 nt, Human
uuugcugugguguuggguggcuccuaucuauu

SEQ ID NO: 546311 - RNA, 32 nt, Human
uuugcuguuaaugcugcugcuuugccaaugaa

SEQ ID NO: 546312 - RNA, 32 nt, Human
uuugcuguugcuugcugaacugugaagaacug

SEQ ID NO: 546313 - RNA, 32 nt, Human
uuugcuguuuucucaugucucucccaguguga

SEQ ID NO: 546314 - RNA, 32 nt, Human
uuugcuuagcauuauucuuuccuauuauuuua

SEQ ID NO: 546315 - RNA, 32 nt, Human
uuugcuuagcccacaagguaucuauuucacuu

SEQ ID NO: 546316 - RNA, 32 nt, Human
uuugcuuaggauugcacuggcuuugggggcuu

SEQ ID NO: 546317 - RNA, 32 nt, Human
uuugcuuaguacucagccagugccacaguuug

SEQ ID NO: 546318 - RNA, 27 nt, Human
uuugcuuagucaccuuuaguggaguaa

SEQ ID NO: 546319 - RNA, 32 nt, Human
uuugcuuaguccuuaccauauguaauaggcag

SEQ ID NO: 546320 - RNA, 32 nt, Human
uuugcuuauucaucaauaacuaauccaauaug

SEQ ID NO: 546321 - RNA, 32 nt, Human
uuugcuucaagcucuguagcaggaccugcccc

SEQ ID NO: 546322 - RNA, 32 nt, Human
uuugcuucacugcaauuuguuucugaucucca

SEQ ID NO: 546323 - RNA, 32 nt, Human
uuugcuucagagacuccuuucuggccuaacag

SEQ ID NO: 546324 - RNA, 32 nt, Human
uuugcuucagcaggauccuugugggccuucua

SEQ ID NO: 546325 - RNA, 32 nt, Human
uuugcuucauucagcccuagcucuguagagaa

SEQ ID NO: 546326 - RNA, 32 nt, Human
uuugcuuccaucauccagccccugggcaacau

SEQ ID NO: 546327 - RNA, 32 nt, Human
uuugcuucccaggcuggagugcaguggugcga

SEQ ID NO: 546328 - RNA, 32 nt, Human
uuugcuuccccacugcccccugcccuccagcc

SEQ ID NO: 546329 - RNA, 32 nt, Human
uuugcuucccuuagaacuacagacucgaaauc

SEQ ID NO: 546330 - RNA, 32 nt, Human
uuugcuuccucccucucuccucccucccagac

SEQ ID NO: 546331 - RNA, 32 nt, Human
uuugcuucuccaagugaagcucagaaauaccu

SEQ ID NO: 546332 - RNA, 32 nt, Human
uuugcuucucgguuauccugugcuucagauga

SEQ ID NO: 546333 - RNA, 32 nt, Human
uuugcuucucucuuaauuaauaacacagacac

SEQ ID NO: 546334 - RNA, 32 nt, Human
uuugcuugaacagcuucuccugaguccuccuu

SEQ ID NO: 546335 - RNA, 32 nt, Human
uuugcuugaacccaagagguccaaggcugcag

SEQ ID NO: 546336 - RNA, 32 nt, Human
uuugcuugaacccaggaggcagagguugcagu

SEQ ID NO: 546337 - RNA, 32 nt, Human
uuugcuugaacccgggaggcggagguugcagu

SEQ ID NO: 546338 - RNA, 32 nt, Human
uuugcuugaagccagaggucaguggccgugcu

SEQ ID NO: 546339 - RNA, 32 nt, Human
uuugcuugagacucagaggaguucucaugaua

SEQ ID NO: 546340 - RNA, 31 nt, Human
uuugcuugccucucuguuuguaaccuugucg

SEQ ID NO: 546341 - RNA, 32 nt, Human
uuugcuugcugaggcccuagacuugacagugg

SEQ ID NO: 546342 - RNA, 32 nt, Human
uuugcuugggcucccccuucauggccucugca

SEQ ID NO: 546343 - RNA, 32 nt, Human
uuugcuuggggaugugcuuggagaggcagaua

SEQ ID NO: 546344 - RNA, 32 nt, Human
uuugcuuguaaaugcaucacgaagaggcagcc

SEQ ID NO: 546345 - RNA, 25 nt, Human
uuugcuuguacagaaucuguaguga

SEQ ID NO: 546346 - RNA, 24 nt, Human
uuugcuugucuuccacuccugcca

SEQ ID NO: 546347 - RNA, 32 nt, Human
uuugcuugugcaaaagggaauagugccgugga

SEQ ID NO: 546348 - RNA, 32 nt, Human
uuugcuuguuacucaucuguugaccuaccugg

SEQ ID NO: 546349 - RNA, 32 nt, Human
uuugcuuuagauuuucuucuguuuucaccauc

SEQ ID NO: 546350 - RNA, 32 nt, Human
uuugcuuuagguuuuugaaacagccccggcga

SEQ ID NO: 546351 - RNA, 32 nt, Human
uuugcuuuaguauuuuaauaagaauuacaaag

SEQ ID NO: 546352 - RNA, 32 nt, Human
uuugcuuuauggccuuuccaucauaguugccc

SEQ ID NO: 546353 - RNA, 21 nt, Human
uuugcuuuccuguauagccag

SEQ ID NO: 546354 - RNA, 32 nt, Human
uuugcuuucucccauuuuuaagagaugguaag

SEQ ID NO: 546355 - RNA, 32 nt, Human
uuugcuuucugcucagcuucuccugugugauu

SEQ ID NO: 546356 - RNA, 32 nt, Human
uuugcuuugacaccugaugccaggacaauagu

SEQ ID NO: 546357 - RNA, 32 nt, Human
uuugcuuuggaugcacuguuguucuguuaagg

SEQ ID NO: 546358 - RNA, 32 nt, Human
uuugcuuuggguuuguggcacccuggccaccc

SEQ ID NO: 546359 - RNA, 32 nt, Human
uuugcuuugugaauuuggcuucauuuuacuua

SEQ ID NO: 546360 - RNA, 32 nt, Human
uuugcuuuguuuuuggacaaaagagucuaaca

SEQ ID NO: 546361 - RNA, 32 nt, Human
uuugcuuuugacuccaggaacaaaaagguaaa

SEQ ID NO: 546362 - RNA, 32 nt, Human
uuugcuuuugcucgaugcagacagggggccag

SEQ ID NO: 546363 - RNA, 32 nt, Human
uuugcuuuugcuucucuccucugaagugugag

SEQ ID NO: 546364 - RNA, 31 nt, Human
uuugcuuuuggagcucuucagaugcuguccc

SEQ ID NO: 546365 - RNA, 32 nt, Human
uuugcuuuuggcggccucugcaggccucgaca

SEQ ID NO: 546366 - RNA, 32 nt, Human
uuugcuuuuucccuuuuccuacagacguauau

SEQ ID NO: 546367 - RNA, 23 nt, Human
uuuggaaaaacccauuccuucca

SEQ ID NO: 546368 - RNA, 32 nt, Human
uuuggaaagaagaaauacacagaugagccccu

SEQ ID NO: 546369 - RNA, 32 nt, Human
uuuggaaagcuacaguaauuucuguauuacau

SEQ ID NO: 546370 - RNA, 32 nt, Human
uuuggaaauauucucauucuuaguggggaugu

SEQ ID NO: 546371 - RNA, 32 nt, Human
uuuggaaauguccucauuauguagaauggaau

SEQ ID NO: 546372 - RNA, 32 nt, Human
uuuggaacaaguguucagagcagacagaagca

SEQ ID NO: 546373 - RNA, 32 nt, Human
uuuggaacaugaauacuccugaggguucacaa

SEQ ID NO: 546374 - RNA, 21 nt, Human
uuuggaaccagacucuugccu

SEQ ID NO: 546375 - RNA, 32 nt, Human
uuuggaacccuuuagcuuuguuuuggaauggc

SEQ ID NO: 546376 - RNA, 32 nt, Human
uuuggaaccuaugaacacuuugaggcugccac

SEQ ID NO: 546377 - RNA, 32 nt, Human
uuuggaacugauucauaagaaaaguuauuaaa

SEQ ID NO: 546378 - RNA, 32 nt, Human
uuuggaacuggguaacaggcaggguuuggaac

SEQ ID NO: 546379 - RNA, 32 nt, Human
uuuggaacuguguuucaaauggacuguuacag

SEQ ID NO: 546380 - RNA, 32 nt, Human
uuuggaagacccagagaggccaagaucccauc

SEQ ID NO: 546381 - RNA, 32 nt, Human
uuuggaagagaaggugaggagcauuucaggau

SEQ ID NO: 546382 - RNA, 32 nt, Human
uuuggaagagcaugaguuccauaucugagaug

SEQ ID NO: 546383 - RNA, 32 nt, Human
uuuggaagauccugugaggagccccaucuguc

SEQ ID NO: 546384 - RNA, 32 nt, Human
uuuggaagaugauaccuuuuugcucagcuguc

SEQ ID NO: 546385 - RNA, 32 nt, Human
uuuggaagaugcagcuugaggucugggggacu

SEQ ID NO: 546386 - RNA, 23 nt, Human
uuuggaagcaguuuccuuuuuca

SEQ ID NO: 546387 - RNA, 31 nt, Human
uuuggaaggcacuucuccugccuccugggag

SEQ ID NO: 546388 - RNA, 32 nt, Human
uuuggaaggcuuccuguuggauuccucuucau

SEQ ID NO: 546389 - RNA, 32 nt, Human
uuuggaaggggucuguagugucacucaaggcg

SEQ ID NO: 546390 - RNA, 32 nt, Human
uuuggaaggugacacugcucccugaauuaagg

SEQ ID NO: 546391 - RNA, 32 nt, Human
uuuggaaggugauacaguauguggguaaccau

SEQ ID NO: 546392 - RNA, 32 nt, Human
uuuggaaguacucugcaguggacauaagcauu

SEQ ID NO: 546393 - RNA, 32 nt, Human
uuuggaaguucaugauauuuugauuucaaugg

SEQ ID NO: 546394 - RNA, 22 nt, Human
uuuggaaucagaagaccuaccu

SEQ ID NO: 546395 - RNA, 32 nt, Human
uuuggaaucgccaguacaugggcaugggcaug

SEQ ID NO: 546396 - RNA, 32 nt, Human
uuuggaaucucaccacauauacuuuguuagau

SEQ ID NO: 546397 - RNA, 18 nt, Human
uuuggaaucucugaagua

SEQ ID NO: 546398 - RNA, 32 nt, Human
uuuggaaucugaagaauccuauguaaaucauu

SEQ ID NO: 546399 - RNA, 32 nt, Human
uuuggaaugguguaagccuaaccacaaguaaa

SEQ ID NO: 546400 - RNA, 32 nt, Human
uuuggaauguucucugugaaccacaguugugu

SEQ ID NO: 546401 - RNA, 32 nt, Human
uuuggaauuggguuuuucaaugaguggcuuua

SEQ ID NO: 546402 - RNA, 21 nt, Human
uuuggaauuuuccuuuucuua

SEQ ID NO: 546403 - RNA, 32 nt, Human
uuuggacacaauagugcacuuuaaaaccugcu

SEQ ID NO: 546404 - RNA, 32 nt, Human
uuuggacacacccaggaaggcuuuugaaguca

SEQ ID NO: 546405 - RNA, 32 nt, Human
uuuggacacaugcacacauacagucucuaggu

SEQ ID NO: 546406 - RNA, 20 nt, Human
uuuggacacuaguugccaag

SEQ ID NO: 546407 - RNA, 21 nt, Human
uuuggacacuucauuccuugc

SEQ ID NO: 546408 - RNA, 32 nt, Human
uuuggacacuuggggaaaagugaggccagucu

SEQ ID NO: 546409 - RNA, 32 nt, Human
uuuggacagaggcauuuucaccuuauggugaa

SEQ ID NO: 546410 - RNA, 32 nt, Human
uuuggacagauggcaggagaggagaacuucaa

SEQ ID NO: 546411 - RNA, 32 nt, Human
uuuggacagcaaccccugagcccaagccaguu

SEQ ID NO: 546412 - RNA, 32 nt, Human
uuuggacagccaagggcagaucacagguuauu

SEQ ID NO: 546413 - RNA, 32 nt, Human
uuuggacagccugagccaggaggcggagaggc

SEQ ID NO: 546414 - RNA, 32 nt, Human
uuuggacagcggaaacuccuucacagcggcug

SEQ ID NO: 546415 - RNA, 23 nt, Human
uuuggacaggccucuuugacaga

SEQ ID NO: 546416 - RNA, 27 nt, Human
uuuggacaucuuuuauuuuuugucaga

SEQ ID NO: 546417 - RNA, 32 nt, Human
uuuggacauggcagaaaccaggugaucagugg

SEQ ID NO: 546418 - RNA, 32 nt, Human
uuuggaccaaccccagaacagagcagagccac

SEQ ID NO: 546419 - RNA, 18 nt, Human
uuuggaccacucccuuca

SEQ ID NO: 546420 - RNA, 32 nt, Human
uuuggaccagccugggcaacauggugaaaccc

SEQ ID NO: 546421 - RNA, 32 nt, Human
uuuggaccaguucuugugccauuggcaggaug

SEQ ID NO: 546422 - RNA, 32 nt, Human
uuuggaccauugguuacaaaacagacacagcc

SEQ ID NO: 546423 - RNA, 23 nt, Human
uuuggaccauuuagcaucaugag

SEQ ID NO: 546424 - RNA, 32 nt, Human
uuuggaccauuuuuccggggaaggagauccag

SEQ ID NO: 546425 - RNA, 32 nt, Human
uuuggacccucagagccccugcagaggacgga

SEQ ID NO: 546426 - RNA, 32 nt, Human
uuuggacccucugcauuauuaaagcugcugua

SEQ ID NO: 546427 - RNA, 32 nt, Human
uuuggaccuaccccuguccuugcugacuugug

SEQ ID NO: 546428 - RNA, 32 nt, Human
uuuggaccuccaggggcuggagcuucaucacc

SEQ ID NO: 546429 - RNA, 32 nt, Human
uuuggaccugacuuugcuucucuccuuuuccu

SEQ ID NO: 546430 - RNA, 32 nt, Human
uuuggacgagcuguacaaggugcuggcagaga

SEQ ID NO: 546431 - RNA, 32 nt, Human
uuuggacuggacugucccugcucauccauucu

SEQ ID NO: 546432 - RNA, 32 nt, Human
uuuggacuggguuuuggaccuccaggggcugg

SEQ ID NO: 546433 - RNA, 32 nt, Human
uuuggacugucuuugaauccugucuuugguac

SEQ ID NO: 546434 - RNA, 32 nt, Human
uuuggacuguguccucagcuccuuccagauga

SEQ ID NO: 546435 - RNA, 32 nt, Human
uuuggacuugagugccuggaagcugaaugccc

SEQ ID NO: 546436 - RNA, 32 nt, Human
uuuggacuuuucucccuuuugcauuuggugcu

SEQ ID NO: 546437 - RNA, 32 nt, Human
uuuggagaaaauacagagacaaaaagaccauu

SEQ ID NO: 546438 - RNA, 32 nt, Human
uuuggagaaagacccagagaucaggcagaggu

SEQ ID NO: 546439 - RNA, 32 nt, Human
uuuggagaacaacauggauuucacagacauca

SEQ ID NO: 546440 - RNA, 25 nt, Human
uuuggagaacaucugcacuuucuua

SEQ ID NO: 546441 - RNA, 32 nt, Human
uuuggagaaccuuuucuucccauugcucucag

SEQ ID NO: 546442 - RNA, 32 nt, Human
uuuggagaagagcaagguguugaggagggcag

SEQ ID NO: 546443 - RNA, 31 nt, Human
uuuggagacaccugguugucacuggaggggg

SEQ ID NO: 546444 - RNA, 32 nt, Human
uuuggagacaggagucaggccaggucugaagc

SEQ ID NO: 546445 - RNA, 32 nt, Human
uuuggagacagggucuucacagaggugaucua

SEQ ID NO: 546446 - RNA, 32 nt, Human
uuuggagacagggucuuuacagagguaauaaa

SEQ ID NO: 546447 - RNA, 32 nt, Human
uuuggagacaguuuugcucuugucuccccggc

SEQ ID NO: 546448 - RNA, 32 nt, Human
uuuggagaccacaguuucuaacagacuuucaa

SEQ ID NO: 546449 - RNA, 32 nt, Human
uuuggagacucuuccuuuuguuuuacacccag

SEQ ID NO: 546450 - RNA, 32 nt, Human
uuuggagaucagccucaccuucucccauccca

SEQ ID NO: 546451 - RNA, 32 nt, Human
uuuggagaugaagauuugacuaacagugagcc

SEQ ID NO: 546452 - RNA, 32 nt, Human
uuuggagauuuuagguaagaaguuuccuguua

SEQ ID NO: 546453 - RNA, 31 nt, Human
uuuggagcacuuuucucuacugcagaucuau

SEQ ID NO: 546454 - RNA, 23 nt, Human
uuuggagcaguucugccuuuuca

SEQ ID NO: 546455 - RNA, 32 nt, Human
uuuggagcauuguucuaaaaaugggaaauuac

SEQ ID NO: 546456 - RNA, 32 nt, Human
uuuggagcccucucuuaagucagaacucuguc

SEQ ID NO: 546457 - RNA, 32 nt, Human
uuuggagcccucuugcuuaguugaaggaguuu

SEQ ID NO: 546458 - RNA, 32 nt, Human
uuuggagcucuauccauauuuuacugaucucu

SEQ ID NO: 546459 - RNA, 32 nt, Human
uuuggagcuggauuuuguuagcuaaacacaua

SEQ ID NO: 546460 - RNA, 32 nt, Human
uuuggagcuuacagucuguucuggggaacaga

SEQ ID NO: 546461 - RNA, 21 nt, Human
uuuggagcuuagccuuacuua

SEQ ID NO: 546462 - RNA, 24 nt, Human
uuuggagcuuuccuucuuuuuuca

SEQ ID NO: 546463 - RNA, 32 nt, Human
uuuggaggaauaaugacccaguauuuguccca

SEQ ID NO: 546464 - RNA, 32 nt, Human
uuuggaggaaucacuggcauuugauggggaau

SEQ ID NO: 546465 - RNA, 32 nt, Human
uuuggaggagaugggagcccagagagcuucca

SEQ ID NO: 546466 - RNA, 32 nt, Human
uuuggaggagggaggcaggaggugagguugga

SEQ ID NO: 546467 - RNA, 32 nt, Human
uuuggaggcagggcugggaagggagcgcucuc

SEQ ID NO: 546468 - RNA, 32 nt, Human
uuuggaggccaaggcggguggaucacgagguc

SEQ ID NO: 546469 - RNA, 32 nt, Human
uuuggaggcccaggcgggcggaucaccugagg

SEQ ID NO: 546470 - RNA, 32 nt, Human
uuuggaggccgagauggguggaucaucugagg

SEQ ID NO: 546471 - RNA, 32 nt, Human
uuuggaggccgaggcaggcggaucacuugagg

SEQ ID NO: 546472 - RNA, 32 nt, Human
uuuggaggccgaggcaggcggaucauuugagg

SEQ ID NO: 546473 - RNA, 32 nt, Human
uuuggaggccgaggcggguagaucaccugagg

SEQ ID NO: 546474 - RNA, 32 nt, Human
uuuggaggcuccaagccucaaagugcccgcag

SEQ ID NO: 546475 - RNA, 32 nt, Human
uuuggaggcugaagcggaaggaucccuuggcc

SEQ ID NO: 546476 - RNA, 32 nt, Human
uuuggaggcugaggcaggagaauugcuugaac

SEQ ID NO: 546477 - RNA, 32 nt, Human
uuuggaggcugaggugggaggaucauuugagc

SEQ ID NO: 546478 - RNA, 32 nt, Human
uuuggaggcuuccugacauuuacaguaauacc

SEQ ID NO: 546479 - RNA, 32 nt, Human
uuuggagggaggggaauggaagggcauggaag

SEQ ID NO: 546480 - RNA, 32 nt, Human
uuuggaggggaggcccaacagcaaagauggag

SEQ ID NO: 546481 - RNA, 32 nt, Human
uuuggaggggcaaggggcagaaugacauaguu

SEQ ID NO: 546482 - RNA, 32 nt, Human
uuuggagggggcaggcaaagucaaagugaaug

SEQ ID NO: 546483 - RNA, 32 nt, Human
uuuggaggggguggggaaauaguucuggugcc

SEQ ID NO: 546484 - RNA, 32 nt, Human
uuuggagguguggagaaggggaagggagggac

SEQ ID NO: 546485 - RNA, 32 nt, Human
uuuggaguaagggacuucauauaccugauucc

SEQ ID NO: 546486 - RNA, 24 nt, Human
uuuggaguauuuugguuuuucuua

SEQ ID NO: 546487 - RNA, 32 nt, Human
uuuggaguccugcugucugggugccagggccg

SEQ ID NO: 546488 - RNA, 24 nt, Human
uuuggagucucucaugaaguuuca

SEQ ID NO: 546489 - RNA, 19 nt, Human
uuuggaguggggggcgugg

SEQ ID NO: 546490 - RNA, 32 nt, Human
uuuggaguggucugaagccucugccuccuucc

SEQ ID NO: 546491 - RNA, 32 nt, Human
uuuggaguguccguuauccugccugcauuugg

SEQ ID NO: 546492 - RNA, 22 nt, Human
uuuggaguuccccauucugcca

SEQ ID NO: 546493 - RNA, 22 nt, Human
uuuggauaaccuuccuucuaaa

SEQ ID NO: 546494 - RNA, 32 nt, Human
uuuggauaacuuauaggaaagccuagaaccuc

SEQ ID NO: 546495 - RNA, 32 nt, Human
uuuggauaagaagagaaaauugaaggagaugu

SEQ ID NO: 546496 - RNA, 32 nt, Human
uuuggauacaauaacaggaccuuaccucacag

SEQ ID NO: 546497 - RNA, 24 nt, Human
uuuggauacuaaggaugugccaaa

SEQ ID NO: 546498 - RNA, 23 nt, Human
uuuggauauuuuaaccuguuaag

SEQ ID NO: 546499 - RNA, 32 nt, Human
uuuggaucaaagaaguguuucucagugaaaug

SEQ ID NO: 546500 - RNA, 32 nt, Human
uuuggaucauagcuuaacaaggcacaggaagg

SEQ ID NO: 546501 - RNA, 32 nt, Human
uuuggaucuaguuucuaaguuauuuuaguguu

SEQ ID NO: 546502 - RNA, 32 nt, Human
uuuggaucuggagcagagucugccauucugcc

SEQ ID NO: 546503 - RNA, 32 nt, Human
uuuggaucuugagacucauccagccugcuaca

SEQ ID NO: 546504 - RNA, 32 nt, Human
uuuggaugaauaaacuuuaugccuaaaacaua

SEQ ID NO: 546505 - RNA, 32 nt, Human
uuuggaugaugauuuggcaagaugcuguaagu

SEQ ID NO: 546506 - RNA, 24 nt, Human
uuuggaugccuccuaugccuggcg

SEQ ID NO: 546507 - RNA, 22 nt, Human
uuuggaugcugugugccuguca

SEQ ID NO: 546508 - RNA, 24 nt, Human
uuuggaugcugugugccugucaag

SEQ ID NO: 546509 - RNA, 26 nt, Human
uuuggaugcuuuuuauacguucucca

SEQ ID NO: 546510 - RNA, 32 nt, Human
uuuggauggaguuucguuuugucgcccaggcu

SEQ ID NO: 546511 - RNA, 21 nt, Human
uuuggauggccaucuccugcu

SEQ ID NO: 546512 - RNA, 19 nt, Human
uuuggauggggaaagggaa

SEQ ID NO: 546513 - RNA, 32 nt, Human
uuuggauggggaagggaaagacuggggaggga

SEQ ID NO: 546514 - RNA, 32 nt, Human
uuuggauggggagggggagcuucugagaaucg

SEQ ID NO: 546515 - RNA, 22 nt, Human
uuuggaugguggggggaugcag

SEQ ID NO: 546516 - RNA, 32 nt, Human
uuuggaugucaugugacccugugccucaguuu

SEQ ID NO: 546517 - RNA, 32 nt, Human
uuuggauguccaaaagcaccagaaggagggug

SEQ ID NO: 546518 - RNA, 32 nt, Human
uuuggaugucccuucccuagggggaaaggcug

SEQ ID NO: 546519 - RNA, 22 nt, Human
uuuggaugucugggcccugcca

SEQ ID NO: 546520 - RNA, 20 nt, Human
uuuggaugugcuuucugcca

SEQ ID NO: 546521 - RNA, 32 nt, Human
uuuggauguggaaguaaaagugcugcuaaaac

SEQ ID NO: 546522 - RNA, 32 nt, Human
uuuggauuagggauuguuuucucacuuaccuu

SEQ ID NO: 546523 - RNA, 32 nt, Human
uuuggauucccugauauguuccuucaaaucug

SEQ ID NO: 546524 - RNA, 32 nt, Human
uuuggauugcagcauucugcucuucugaugau

SEQ ID NO: 546525 - RNA, 32 nt, Human
uuuggauugcccucuuucaauuuccuugugaa

SEQ ID NO: 546526 - RNA, 32 nt, Human
uuuggauuguguccucugcagcuuuugauaug

SEQ ID NO: 546527 - RNA, 32 nt, Human
uuuggauuuauucaaaguacuaugggaaucca

SEQ ID NO: 546528 - RNA, 32 nt, Human
uuuggauuucucaucaugcaauagcaaaguca

SEQ ID NO: 546529 - RNA, 32 nt, Human
uuuggauuuugaaaagaaaacuuuccucccuc

SEQ ID NO: 546530 - RNA, 32 nt, Human
uuuggcaaacagcaaugaucuuccaauaaaag

SEQ ID NO: 546531 - RNA, 32 nt, Human
uuuggcaaaccaggagcucagcugcaggaggc

SEQ ID NO: 546532 - RNA, 32 nt, Human
uuuggcaaaggagugugaguuuuggggaagcu

SEQ ID NO: 546533 - RNA, 32 nt, Human
uuuggcaacuccugggccacacggccugccuc

SEQ ID NO: 546534 - RNA, 32 nt, Human
uuuggcaauggaagaagauuaguauuagagga

SEQ ID NO: 546535 - RNA, 32 nt, Human
uuuggcacagccgcgccacgcgaucggcgauc

SEQ ID NO: 546536 - RNA, 32 nt, Human
uuuggcacaguucaucacuccaguuuguuacu

SEQ ID NO: 546537 - RNA, 32 nt, Human
uuuggcacuggcaucaguguaaagggcucugc

SEQ ID NO: 546538 - RNA, 32 nt, Human
uuuggcagaacagucacuguccuuguaaaguu

SEQ ID NO: 546539 - RNA, 32 nt, Human
uuuggcagacaggucagagaccacugaagaac

SEQ ID NO: 546540 - RNA, 32 nt, Human
uuuggcagccaaguggauggaacuaacuuucc

SEQ ID NO: 546541 - RNA, 32 nt, Human
uuuggcagccaggugacccacacucuggacag

SEQ ID NO: 546542 - RNA, 32 nt, Human
uuuggcagcuccucaucucucuucuaauccac

SEQ ID NO: 546543 - RNA, 21 nt, Human
uuuggcagcuuggugggcgua

SEQ ID NO: 546544 - RNA, 19 nt, Human
uuuggcaggcaggugccag

SEQ ID NO: 546545 - RNA, 32 nt, Human
uuuggcagggccugagaagauggucugacuuc

SEQ ID NO: 546546 - RNA, 32 nt, Human
uuuggcagggccugggccaucccugggacaaa

SEQ ID NO: 546547 - RNA, 23 nt, Human
uuuggcaggugucgggggcgcag

SEQ ID NO: 546548 - RNA, 32 nt, Human
uuuggcaguauuucuuuacaaauguggcaaag

SEQ ID NO: 546549 - RNA, 32 nt, Human
uuuggcagucugaugcagagccugcacucugg

SEQ ID NO: 546550 - RNA, 19 nt, Human
uuuggcagugaggucguag

SEQ ID NO: 546551 - RNA, 32 nt, Human
uuuggcaguuaagcagugccacacuacagggu

SEQ ID NO: 546552 - RNA, 32 nt, Human
uuuggcaguucugccaggcaagcccuguguuc

SEQ ID NO: 546553 - RNA, 32 nt, Human
uuuggcauagccuguguuugcagugagaguga

SEQ ID NO: 546554 - RNA, 32 nt, Human
uuuggcauccccagcaucaccacucucccaac

SEQ ID NO: 546555 - RNA, 32 nt, Human
uuuggcaucuguucccuggcugugccaagaug

SEQ ID NO: 546556 - RNA, 23 nt, Human
uuuggcauguucccauuuuugcu

SEQ ID NO: 546557 - RNA, 32 nt, Human
uuuggccaaaacagaacaaaugcugaaaagga

SEQ ID NO: 546558 - RNA, 32 nt, Human
uuuggccaaugccuauaaaaugcccauuucga

SEQ ID NO: 546559 - RNA, 32 nt, Human
uuuggccacaagaauaagcagcaaauaaacaa

SEQ ID NO: 546560 - RNA, 22 nt, Human
uuuggccacacaguggcacugg

SEQ ID NO: 546561 - RNA, 32 nt, Human
uuuggccacaggccuguguuccugggcugaug

SEQ ID NO: 546562 - RNA, 32 nt, Human
uuuggccagcagaaagagaguaggccggaugu

SEQ ID NO: 546563 - RNA, 22 nt, Human
uuuggccaggcccuggcacuga

SEQ ID NO: 546564 - RNA, 32 nt, Human
uuuggccagguggacuguggcagaucaauaaa

SEQ ID NO: 546565 - RNA, 21 nt, Human
uuuggccaguccccacuccca

SEQ ID NO: 546566 - RNA, 21 nt, Human
uuuggccaucaaaccacccca

SEQ ID NO: 546567 - RNA, 21 nt, Human
uuuggccaucccaccuauccc

SEQ ID NO: 546568 - RNA, 32 nt, Human
uuuggccauugauauucaacaggucacugacc

SEQ ID NO: 546569 - RNA, 32 nt, Human
uuuggccauuuccaccuggugaagauuuucau

SEQ ID NO: 546570 - RNA, 28 nt, Human
uuuggcccaaguguggccccauuagcga

SEQ ID NO: 546571 - RNA, 32 nt, Human
uuuggcccaaguuugggcaacauuuggcccaa

SEQ ID NO: 546572 - RNA, 32 nt, Human
uuuggcccagcacccacccugccagggaggaa

SEQ ID NO: 546573 - RNA, 32 nt, Human
uuuggcccagccuguacuggugugccgcaaug

SEQ ID NO: 546574 - RNA, 32 nt, Human
uuuggccccaacccacacaggccaaugcaaga

SEQ ID NO: 546575 - RNA, 32 nt, Human
uuuggccccucccaggccaucagucugcacuu

SEQ ID NO: 546576 - RNA, 32 nt, Human
uuuggcccuucaucuauuuaaucauagcuaca

SEQ ID NO: 546577 - RNA, 25 nt, Human
uuuggccuagagguguggagugaga

SEQ ID NO: 546578 - RNA, 32 nt, Human
uuuggccuccaacugggcaccaugagggccug

SEQ ID NO: 546579 - RNA, 32 nt, Human
uuuggccugcagauggacugccuggccagagg

SEQ ID NO: 546580 - RNA, 32 nt, Human
uuuggccugcucacccgaccagccugggccgc

SEQ ID NO: 546581 - RNA, 32 nt, Human
uuuggccugcucaugaccuccaccccugagau

SEQ ID NO: 546582 - RNA, 32 nt, Human
uuuggccuggagaagggagggcgggcuagaag

SEQ ID NO: 546583 - RNA, 32 nt, Human
uuuggccugggagguccaggcugcaaugagcc

SEQ ID NO: 546584 - RNA, 32 nt, Human
uuuggccugguguggacggaaaggguggccaa

SEQ ID NO: 546585 - RNA, 32 nt, Human
uuuggccuuaguuccagguagauuaaaaagcu

SEQ ID NO: 546586 - RNA, 32 nt, Human
uuuggccuuucacuucugccuucuguugagaa

SEQ ID NO: 546587 - RNA, 26 nt, Human
uuuggccuuuccucuuugucuuucca

SEQ ID NO: 546588 - RNA, 24 nt, Human
uuuggccuuugugagggagcgagg

SEQ ID NO: 546589 - RNA, 32 nt, Human
uuuggcgagacagggucucacucuguuaccca

SEQ ID NO: 546590 - RNA, 32 nt, Human
uuuggcgagggcccuugaucaccuugccccuc

SEQ ID NO: 546591 - RNA, 20 nt, Human
uuuggcgggaggggaagugg

SEQ ID NO: 546592 - RNA, 20 nt, Human
uuuggcgggcuggggagcgg

SEQ ID NO: 546593 - RNA, 32 nt, Human
uuuggcgggguuuccucaucuccccagccuga

SEQ ID NO: 546594 - RNA, 32 nt, Human
uuuggcgucagaaguccuuaccucuuuauauu

SEQ ID NO: 546595 - RNA, 32 nt, Human
uuuggcgucccaguccugccucugcuccugcc

SEQ ID NO: 546596 - RNA, 32 nt, Human
uuuggcuaaauguauuggcacgauuauuagaa

SEQ ID NO: 546597 - RNA, 32 nt, Human
uuuggcuaagaauguuguuaccaucuucuuug

SEQ ID NO: 546598 - RNA, 32 nt, Human
uuuggcuacuuccagcaggauaccaaggguuu

SEQ ID NO: 546599 - RNA, 32 nt, Human
uuuggcuauggguggagggugaguuugaagag

SEQ ID NO: 546600 - RNA, 32 nt, Human
uuuggcuauggugaguaauacugcuauggaua

SEQ ID NO: 546601 - RNA, 32 nt, Human
uuuggcuauuaaagauauguauuagauggucu

SEQ ID NO: 546602 - RNA, 29 nt, Human
uuuggcuauuccgguuauccuaccuacaa

SEQ ID NO: 546603 - RNA, 32 nt, Human
uuuggcuauuuauuaaccucucuuucauauuc

SEQ ID NO: 546604 - RNA, 32 nt, Human
uuuggcucaaguccauuuggcuguagugucaa

SEQ ID NO: 546605 - RNA, 32 nt, Human
uuuggcucaccuuguaucagcaaacaaaguac

SEQ ID NO: 546606 - RNA, 32 nt, Human
uuuggcucacugcaaccuccaccucccagguu

SEQ ID NO: 546607 - RNA, 32 nt, Human
uuuggcucacugcaaccuccgccuccgggguu

SEQ ID NO: 546608 - RNA, 32 nt, Human
uuuggcucacugcaaccuccgccuucuggguu

SEQ ID NO: 546609 - RNA, 32 nt, Human
uuuggcucacugcaagcucugccucccggguu

SEQ ID NO: 546610 - RNA, 32 nt, Human
uuuggcucacugcagccuccgccuucuggguu

SEQ ID NO: 546611 - RNA, 32 nt, Human
uuuggcucacugcagccucugccucccaggcu

SEQ ID NO: 546612 - RNA, 32 nt, Human
uuuggcucaggccugugaucccagcacuuugg

SEQ ID NO: 546613 - RNA, 32 nt, Human
uuuggcucaugugauccucccaucucagccuc

SEQ ID NO: 546614 - RNA, 32 nt, Human
uuuggcucccaggcuggaguccagugguguga

SEQ ID NO: 546615 - RNA, 32 nt, Human
uuuggcuccucuaguaagaugcacugaaaacu

SEQ ID NO: 546616 - RNA, 32 nt, Human
uuuggcucguaacaguuucagcuuucuuguua

SEQ ID NO: 546617 - RNA, 32 nt, Human
uuuggcucuaggaaggcuuccaugcagugaca

SEQ ID NO: 546618 - RNA, 32 nt, Human
uuuggcucucccucacucucugaggcuccagc

SEQ ID NO: 546619 - RNA, 32 nt, Human
uuuggcucuccucagaagaaagaaucuuucca

SEQ ID NO: 546620 - RNA, 32 nt, Human
uuuggcucucucaccagcaccauggcuguugg

SEQ ID NO: 546621 - RNA, 32 nt, Human
uuuggcucucugccuucucuucauguuggccu

SEQ ID NO: 546622 - RNA, 32 nt, Human
uuuggcucugcuaccugcuccugaagccccgc

SEQ ID NO: 546623 - RNA, 32 nt, Human
uuuggcucuguuuugcuauauccccuaauuug

SEQ ID NO: 546624 - RNA, 25 nt, Human
uuuggcucuucuuuguuuugucuca

SEQ ID NO: 546625 - RNA, 32 nt, Human
uuuggcucuuucucccccgcaaggacccgcug

SEQ ID NO: 546626 - RNA, 32 nt, Human
uuuggcugaacaaaugaguaguggcuucagug

SEQ ID NO: 546627 - RNA, 32 nt, Human
uuuggcugaacuguccuuucucaacagaagcg

SEQ ID NO: 546628 - RNA, 32 nt, Human
uuuggcugacucuucaagaaugccauucaaca

SEQ ID NO: 546629 - RNA, 32 nt, Human
uuuggcugcacuguuaccugcacagagaagag

SEQ ID NO: 546630 - RNA, 32 nt, Human
uuuggcugcagaguggccuggccaacucacac

SEQ ID NO: 546631 - RNA, 31 nt, Human
uuuggcugccauuuuuagcuaccucaaagga

SEQ ID NO: 546632 - RNA, 32 nt, Human
uuuggcugcccaggcucgccuugacuccaaau

SEQ ID NO: 546633 - RNA, 31 nt, Human
uuuggcugccucugucggucuguucaguuac

SEQ ID NO: 546634 - RNA, 18 nt, Human
uuuggcugcgggugcaaa

SEQ ID NO: 546635 - RNA, 32 nt, Human
uuuggcugcucuccaucucuuguaccagccca

SEQ ID NO: 546636 - RNA, 32 nt, Human
uuuggcuggacccaaaagauccagugugguca

SEQ ID NO: 546637 - RNA, 32 nt, Human
uuuggcuggacccagaguccgcguggaaccgc

SEQ ID NO: 546638 - RNA, 32 nt, Human
uuuggcuggagcacuuguguccaugcauguac

SEQ ID NO: 546639 - RNA, 21 nt, Human
uuuggcuggggaggggggcag

SEQ ID NO: 546640 - RNA, 32 nt, Human
uuuggcugucacucccugugcauggucugacc

SEQ ID NO: 546641 - RNA, 32 nt, Human
uuuggcugugacuggguggggcagcaugcagc

SEQ ID NO: 546642 - RNA, 32 nt, Human
uuuggcuuaacuuucugccauugacuuugggu

SEQ ID NO: 546643 - RNA, 21 nt, Human
uuuggcuuauuuuccauccca

SEQ ID NO: 546644 - RNA, 32 nt, Human
uuuggcuuccaaugcuauugcugcaugcugaa

SEQ ID NO: 546645 - RNA, 32 nt, Human
uuuggcuuccugaaccuuucugcccccacuuu

SEQ ID NO: 546646 - RNA, 32 nt, Human
uuuggcuuccuucucacauuucuuuagcuuug

SEQ ID NO: 546647 - RNA, 32 nt, Human
uuuggcuucuaggaacaguugacuucccagaa

SEQ ID NO: 546648 - RNA, 32 nt, Human
uuuggcuucucagcaggcagcugacugaggag

SEQ ID NO: 546649 - RNA, 32 nt, Human
uuuggcuucuguacuggcugaggacaggggag

SEQ ID NO: 546650 - RNA, 32 nt, Human
uuuggcuugagauuuaaaauuauaacugauaa

SEQ ID NO: 546651 - RNA, 22 nt, Human
uuuggcuuuaaagguaagccug

SEQ ID NO: 546652 - RNA, 32 nt, Human
uuuggcuuucaucgcuuuuucuacauguuuuu

SEQ ID NO: 546653 - RNA, 32 nt, Human
uuuggcuuuugauuugcccuguguucuccuga

SEQ ID NO: 546654 - RNA, 32 nt, Human
uuugggaaagagacaggaaagauucacuugaa

SEQ ID NO: 546655 - RNA, 21 nt, Human
uuugggaaaggcuugcagugg

SEQ ID NO: 546656 - RNA, 32 nt, Human
uuugggaaaggggaaagagagcauggaggggu

SEQ ID NO: 546657 - RNA, 32 nt, Human
uuugggaacuccuuuccaaagccauauuuuug

SEQ ID NO: 546658 - RNA, 22 nt, Human
uuugggaacucugucuuucuca

SEQ ID NO: 546659 - RNA, 32 nt, Human
uuugggaagaggagaaaguucuggagaggaug

SEQ ID NO: 546660 - RNA, 32 nt, Human
uuugggaaggagcgugucuggccagguucugc

SEQ ID NO: 546661 - RNA, 32 nt, Human
uuugggaagguaaagaaagaaggaaggaggga

SEQ ID NO: 546662 - RNA, 32 nt, Human
uuugggaagucccgggagcagcgcggcggcac

SEQ ID NO: 546663 - RNA, 32 nt, Human
uuugggaaguggaggugggagaaucacuugag

SEQ ID NO: 546664 - RNA, 32 nt, Human
uuugggaagugggugaggcugggcagggccug

SEQ ID NO: 546665 - RNA, 32 nt, Human
uuugggaauucuacuggcaaggguugagucuu

SEQ ID NO: 546666 - RNA, 32 nt, Human
uuugggaccagcccgggcaacauagcaagacc

SEQ ID NO: 546667 - RNA, 24 nt, Human
uuugggaccagccugaccaacaug

SEQ ID NO: 546668 - RNA, 32 nt, Human
uuugggaccagccugaccaacauggugaaaua

SEQ ID NO: 546669 - RNA, 22 nt, Human
uuugggaccagccuggccaaca

SEQ ID NO: 546670 - RNA, 24 nt, Human
uuugggaccagccuggccaacaug

SEQ ID NO: 546671 - RNA, 32 nt, Human
uuugggaccagccuggccaacauggugaaacc

SEQ ID NO: 546672 - RNA, 24 nt, Human
uuugggaccagccugggcaacaua

SEQ ID NO: 546673 - RNA, 32 nt, Human
uuugggaccagccugggcaacauagggggauc

SEQ ID NO: 546674 - RNA, 24 nt, Human
uuugggaccagccugggcuauaua

SEQ ID NO: 546675 - RNA, 32 nt, Human
uuugggaccagccugggcuauauagcaagacc

SEQ ID NO: 546676 - RNA, 32 nt, Human
uuugggaccauggagcgguaccuaaaacagau

SEQ ID NO: 546677 - RNA, 32 nt, Human
uuugggaccccacacacuccaggugggaucag

SEQ ID NO: 546678 - RNA, 32 nt, Human
uuugggaccccagccugcuggaggcugucaag

SEQ ID NO: 546679 - RNA, 32 nt, Human
uuugggaccgaugggugcuggggaggaucccc

SEQ ID NO: 546680 - RNA, 32 nt, Human
uuugggacuauuccaccuccuuccccugagcc

SEQ ID NO: 546681 - RNA, 32 nt, Human
uuugggacugccccggcaacuccagggugucu

SEQ ID NO: 546682 - RNA, 32 nt, Human
uuugggacugucuugagaaaacagauaaugau

SEQ ID NO: 546683 - RNA, 32 nt, Human
uuugggagauccuggaaaagaucccuucaguu

SEQ ID NO: 546684 - RNA, 32 nt, Human
uuugggagauggauugcuugagcucgggaaga

SEQ ID NO: 546685 - RNA, 32 nt, Human
uuugggagcacaccugcuuugccuugcugccu

SEQ ID NO: 546686 - RNA, 32 nt, Human
uuugggagcagacagaccagagccaccagcca

SEQ ID NO: 546687 - RNA, 32 nt, Human
uuugggagcaguuggcuucugguuuuaaacac

SEQ ID NO: 546688 - RNA, 32 nt, Human
uuugggagcucaauacaaagaugccagcauga

SEQ ID NO: 546689 - RNA, 32 nt, Human
uuugggaggaacuagggucagaaugauguggu

SEQ ID NO: 546690 - RNA, 32 nt, Human
uuugggaggagguggcauuggaaauagcagag

SEQ ID NO: 546691 - RNA, 32 nt, Human
uuugggaggccaagacaggugcaucaguugag

SEQ ID NO: 546692 - RNA, 32 nt, Human
uuugggaggccaaggcgguggaucacaaaguc

SEQ ID NO: 546693 - RNA, 22 nt, Human
uuugggaggccagugcaggugg

SEQ ID NO: 546694 - RNA, 32 nt, Human
uuugggaggccgagacaggcagaucacaaggu

SEQ ID NO: 546695 - RNA, 32 nt, Human
uuugggaggccgagacaggcagauugcccgag

SEQ ID NO: 546696 - RNA, 32 nt, Human
uuugggaggccgaggcagguggaugacaaggu

SEQ ID NO: 546697 - RNA, 32 nt, Human
uuugggaggcgaggcagguagaucaugagguc

SEQ ID NO: 546698 - RNA, 32 nt, Human
uuugggaggcggaggcaggcggguugcuugag

SEQ ID NO: 546699 - RNA, 21 nt, Human
uuugggaggcggaggcgggug

SEQ ID NO: 546700 - RNA, 22 nt, Human
uuugggaggcggaggcgggugg

SEQ ID NO: 546701 - RNA, 22 nt, Human
uuugggaggcggaggugagcag

SEQ ID NO: 546702 - RNA, 32 nt, Human
uuugggaggcugagacaggcagaucacuugag

SEQ ID NO: 546703 - RNA, 32 nt, Human
uuugggaggcugaggggguggaucaccugagg

SEQ ID NO: 546704 - RNA, 22 nt, Human
uuugggaggcugaguugggugg

SEQ ID NO: 546705 - RNA, 32 nt, Human
uuugggagggcaagacagggaggaggccgcuu

SEQ ID NO: 546706 - RNA, 32 nt, Human
uuugggagggggaggcaggcagaucacgacgu

SEQ ID NO: 546707 - RNA, 32 nt, Human
uuugggagggggaggcaggcagaucacgaugu

SEQ ID NO: 546708 - RNA, 32 nt, Human
uuugggagggugagacacugcacagaagacag

SEQ ID NO: 546709 - RNA, 26 nt, Human
uuugggaggucaguuguucuaccuca

SEQ ID NO: 546710 - RNA, 22 nt, Human
uuugggagguggaggcgggugg

SEQ ID NO: 546711 - RNA, 32 nt, Human
uuugggagguggaggugggcggaucacgugag

SEQ ID NO: 546712 - RNA, 32 nt, Human
uuugggaggugggguuuugccauguugcccag

SEQ ID NO: 546713 - RNA, 32 nt, Human
uuugggagucugagacaggcagaucaccugag

SEQ ID NO: 546714 - RNA, 32 nt, Human
uuugggauaagaagggacaaggugcuucuagc

SEQ ID NO: 546715 - RNA, 32 nt, Human
uuugggaucagccuggccaaugugguaaaacc

SEQ ID NO: 546716 - RNA, 32 nt, Human
uuugggaucuugaaucaggaagcugauucaag

SEQ ID NO: 546717 - RNA, 32 nt, Human
uuugggauuaaaacugucaagacuggauaggu

SEQ ID NO: 546718 - RNA, 32 nt, Human
uuugggauuucucucugucauccuggucgacg

SEQ ID NO: 546719 - RNA, 32 nt, Human
uuugggauuuuccuccucuuaacuuucuuaau

SEQ ID NO: 546720 - RNA, 32 nt, Human
uuugggauuuugagagccuucaucucaauuuc

SEQ ID NO: 546721 - RNA, 32 nt, Human
uuugggcaacauggcgaaacccugccucuaca

SEQ ID NO: 546722 - RNA, 32 nt, Human
uuugggcaccuaaugaaaaagacauggaggcc

SEQ ID NO: 546723 - RNA, 32 nt, Human
uuugggcacugucuuuuuaagagaccaaggca

SEQ ID NO: 546724 - RNA, 32 nt, Human
uuugggcagacccugagcagaauacuggucuc

SEQ ID NO: 546725 - RNA, 32 nt, Human
uuugggcagccuugccuccagagagcagauuc

SEQ ID NO: 546726 - RNA, 32 nt, Human
uuugggccaagaaggagagggagaaaggcccg

SEQ ID NO: 546727 - RNA, 32 nt, Human
uuugggccacugcaaagauuccagccuggguc

SEQ ID NO: 546728 - RNA, 32 nt, Human
uuugggccacugcacucuagccuggcaacaga

SEQ ID NO: 546729 - RNA, 32 nt, Human
uuugggccagaacuuccuauuucacuccagca

SEQ ID NO: 546730 - RNA, 32 nt, Human
uuugggccagaggcagccucugcacucccacg

SEQ ID NO: 546731 - RNA, 32 nt, Human
uuugggccagggcagaggaugaggcuggcagc

SEQ ID NO: 546732 - RNA, 32 nt, Human
uuugggccaugcaugcaaagucaaaguuuaaa

SEQ ID NO: 546733 - RNA, 32 nt, Human
uuugggccccggagguagagguugcagugagc

SEQ ID NO: 546734 - RNA, 32 nt, Human
uuugggccucacgugcagacccugccaugcag

SEQ ID NO: 546735 - RNA, 32 nt, Human
uuugggccucagguauccaaagagcacauuuu

SEQ ID NO: 546736 - RNA, 32 nt, Human
uuugggcggggccauccagccuuggcaaggcc

SEQ ID NO: 546737 - RNA, 32 nt, Human
uuugggcuagaagugaggagaaucccuaaacu

SEQ ID NO: 546738 - RNA, 32 nt, Human
uuugggcuagaggcaggaaggaagugggauga

SEQ ID NO: 546739 - RNA, 32 nt, Human
uuugggcuccauccccaccccugcucacuucc

SEQ ID NO: 546740 - RNA, 32 nt, Human
uuugggcuccuaugauaaucuaaugccacugc

SEQ ID NO: 546741 - RNA, 32 nt, Human
uuugggcugcaagugcucacagcucuuguucu

SEQ ID NO: 546742 - RNA, 32 nt, Human
uuugggcuuaguauuucucaggaagagcuaug

SEQ ID NO: 546743 - RNA, 32 nt, Human
uuuggggaaaggacagggugcuagugaguacu

SEQ ID NO: 546744 - RNA, 32 nt, Human
uuuggggaagaacucuacaaaagggaaauguc

SEQ ID NO: 546745 - RNA, 32 nt, Human
uuuggggaaggugauuugugggagacucuagu

SEQ ID NO: 546746 - RNA, 32 nt, Human
uuuggggaauuauuugagaaagcaaaacaaaa

SEQ ID NO: 546747 - RNA, 32 nt, Human
uuuggggacucaauaaacccucacugacuuuu

SEQ ID NO: 546748 - RNA, 32 nt, Human
uuuggggagaccgaggcuggcagaucacuuaa

SEQ ID NO: 546749 - RNA, 32 nt, Human
uuuggggagagggaggggagagaccacagccg

SEQ ID NO: 546750 - RNA, 32 nt, Human
uuuggggagccugucucuccagaagccuuucu

SEQ ID NO: 546751 - RNA, 32 nt, Human
uuuggggagggagggggaagccuuuauucuuu

SEQ ID NO: 546752 - RNA, 32 nt, Human
uuuggggagggcccugaggaccuggccccggg

SEQ ID NO: 546753 - RNA, 32 nt, Human
uuuggggaggggcuggaggacuuccgcacgcu

SEQ ID NO: 546754 - RNA, 32 nt, Human
uuuggggagggggagaaagaagaaagggauug

SEQ ID NO: 546755 - RNA, 32 nt, Human
uuuggggauaaauaaguuagagcauaucuaaa

SEQ ID NO: 546756 - RNA, 32 nt, Human
uuuggggauagggucccugaagaagucacuca

SEQ ID NO: 546757 - RNA, 32 nt, Human
uuuggggaucaagaacuguaaauuuauguauc

SEQ ID NO: 546758 - RNA, 32 nt, Human
uuuggggauguggagguaguuggguagaaaaa

SEQ ID NO: 546759 - RNA, 21 nt, Human
uuuggggccacuguaggggua

SEQ ID NO: 546760 - RNA, 32 nt, Human
uuuggggccauggaagauuggaaacaaagauu

SEQ ID NO: 546761 - RNA, 32 nt, Human
uuuggggcuaaagacugaucucaggggucuua

SEQ ID NO: 546762 - RNA, 32 nt, Human
uuuggggcucuaucgcgcaucucuccuaccaa

SEQ ID NO: 546763 - RNA, 32 nt, Human
uuuggggcugaaaugagugauccugccucugg

SEQ ID NO: 546764 - RNA, 32 nt, Human
uuuggggcugggcugguucuccacccucgcag

SEQ ID NO: 546765 - RNA, 20 nt, Human
uuuggggcuuuuauuucuca

SEQ ID NO: 546766 - RNA, 32 nt, Human
uuugggggaaacugaggcaguggggaagacag

SEQ ID NO: 546767 - RNA, 32 nt, Human
uuugggggaacuaguggcauggggucagggag

SEQ ID NO: 546768 - RNA, 32 nt, Human
uuugggggagagagcagggaguggcucaggga

SEQ ID NO: 546769 - RNA, 19 nt, Human
uuugggggagugggcgcag

SEQ ID NO: 546770 - RNA, 32 nt, Human
uuugggggaucaagggaagagauggaacucuu

SEQ ID NO: 546771 - RNA, 32 nt, Human
uuugggggcagccauccuccaccagaaagggg

SEQ ID NO: 546772 - RNA, 24 nt, Human
uuugggggcagggagguugggugg

SEQ ID NO: 546773 - RNA, 32 nt, Human
uuugggggcagugagagagagcuggaaagggg

SEQ ID NO: 546774 - RNA, 32 nt, Human
uuugggggccgaggcggguggaucaccugagg

SEQ ID NO: 546775 - RNA, 32 nt, Human
uuugggggcuccaggacuacaguagaaaagua

SEQ ID NO: 546776 - RNA, 32 nt, Human
uuugggggcuggcuacauugcuggugggauua

SEQ ID NO: 546777 - RNA, 32 nt, Human
uuugggggcuguaugacguacuggucgguagu

SEQ ID NO: 546778 - RNA, 19 nt, Human
uuuggggggaggggggugg

SEQ ID NO: 546779 - RNA, 18 nt, Human
uuuggggggagggggugu

SEQ ID NO: 546780 - RNA, 24 nt, Human
uuuggggggccaguaguucaguga

SEQ ID NO: 546781 - RNA, 23 nt, Human
uuugggggguggaguuucaguga

SEQ ID NO: 546782 - RNA, 32 nt, Human
uuugggggucccuuuugugucucccccgccau

SEQ ID NO: 546783 - RNA, 32 nt, Human
uuugggggugcuaauccaggacagcauuacac

SEQ ID NO: 546784 - RNA, 32 nt, Human
uuugggggugggccuaucugggugcauuaugg

SEQ ID NO: 546785 - RNA, 20 nt, Human
uuuggggguggggguugcgg

SEQ ID NO: 546786 - RNA, 32 nt, Human
uuuggggguuggucagcaacuuugagugccau

SEQ ID NO: 546787 - RNA, 23 nt, Human
uuugggguaagaaaacaaacaug

SEQ ID NO: 546788 - RNA, 32 nt, Human
uuugggguaugggagagaagagaaugcacaaa

SEQ ID NO: 546789 - RNA, 32 nt, Human
uuugggguauuaagaguacugcaguccgaaac

SEQ ID NO: 546790 - RNA, 32 nt, Human
uuuggggucccagagccugcucugugcacuga

SEQ ID NO: 546791 - RNA, 32 nt, Human
uuugggguccuagcccagugcuucuccaacac

SEQ ID NO: 546792 - RNA, 32 nt, Human
uuuggggucucaaagaagcaguggccaccacc

SEQ ID NO: 546793 - RNA, 32 nt, Human
uuuggggucugaggagaaacaggcuggggccu

SEQ ID NO: 546794 - RNA, 32 nt, Human
uuuggggucugccugggggaggaggggagaaa

SEQ ID NO: 546795 - RNA, 32 nt, Human
uuuggggugaguaggcuucaauucccagcucu

SEQ ID NO: 546796 - RNA, 32 nt, Human
uuuggggugauagcacuuucaggcaggagcua

SEQ ID NO: 546797 - RNA, 18 nt, Human
uuuggggugggggcgggg

SEQ ID NO: 546798 - RNA, 32 nt, Human
uuuggggugugggcagcacccugaacaaaacu

SEQ ID NO: 546799 - RNA, 32 nt, Human
uuuggggugugggcagcgcccugaacaagacu

SEQ ID NO: 546800 - RNA, 24 nt, Human
uuugggguuggggaaagggccccu

SEQ ID NO: 546801 - RNA, 21 nt, Human
uuugggguuucuuuguccuca

SEQ ID NO: 546802 - RNA, 24 nt, Human
uuugggguuuuuguugccuuuuuu

SEQ ID NO: 546803 - RNA, 32 nt, Human
uuuggguaaugugaaucagugccugaggaccu

SEQ ID NO: 546804 - RNA, 32 nt, Human
uuuggguacauucucauugaauuuccuucaaa

SEQ ID NO: 546805 - RNA, 32 nt, Human
uuuggguacuuucuuuucuuccugccguucuu

SEQ ID NO: 546806 - RNA, 32 nt, Human
uuuggguagcuauugucaacugccuucccaug

SEQ ID NO: 546807 - RNA, 27 nt, Human
uuuggguaucugcuuucauuccugaca

SEQ ID NO: 546808 - RNA, 32 nt, Human
uuuggguauuugcacuauuuugggagcaaguu

SEQ ID NO: 546809 - RNA, 32 nt, Human
uuugggucacugcagaucucugagucccccuu

SEQ ID NO: 546810 - RNA, 32 nt, Human
uuugggucauguuuuuaaccaccuggcaauac

SEQ ID NO: 546811 - RNA, 20 nt, Human
uuugggucccugucuuucuc

SEQ ID NO: 546812 - RNA, 32 nt, Human
uuugggucccugucuuucucugagccugucuc

SEQ ID NO: 546813 - RNA, 32 nt, Human
uuuggguccugcagagcugggcucaggcccug

SEQ ID NO: 546814 - RNA, 32 nt, Human
uuugggucuccaggauccucauggaaggggaa

SEQ ID NO: 546815 - RNA, 32 nt, Human
uuugggucucccauacugcguauagaugaaug

SEQ ID NO: 546816 - RNA, 32 nt, Human
uuugggucucguugcuucaugguauggucugg

SEQ ID NO: 546817 - RNA, 32 nt, Human
uuugggucucuuagaccuuaccucucaacucc

SEQ ID NO: 546818 - RNA, 32 nt, Human
uuugggucucuuggaggcuaggguucuguggc

SEQ ID NO: 546819 - RNA, 32 nt, Human
uuugggugaagguaaggaaugagggaagagga

SEQ ID NO: 546820 - RNA, 32 nt, Human
uuugggugaccagccacucaaaggaacuuucu

SEQ ID NO: 546821 - RNA, 32 nt, Human
uuugggugcaccuggccugcucuucccauguu

SEQ ID NO: 546822 - RNA, 32 nt, Human
uuugggugcagacaggcacacagggagaacac

SEQ ID NO: 546823 - RNA, 32 nt, Human
uuuggguggacuccagccuccccagcaacaau

SEQ ID NO: 546824 - RNA, 32 nt, Human
uuugggugggacucuaagcaguauuugcagaa

SEQ ID NO: 546825 - RNA, 32 nt, Human
uuuggguguccucaccagcaaggcugcucggg

SEQ ID NO: 546826 - RNA, 32 nt, Human
uuugggugucugcugagcaagcacgugaauga

SEQ ID NO: 546827 - RNA, 22 nt, Human
uuugggugucuucuguugguca

SEQ ID NO: 546828 - RNA, 32 nt, Human
uuuggguguggggcaggcagagagggauggug

SEQ ID NO: 546829 - RNA, 32 nt, Human
uuugggugugugugcaugcacauguguguguu

SEQ ID NO: 546830 - RNA, 32 nt, Human
uuuggguguuuucuggggauguuaacauggga

SEQ ID NO: 546831 - RNA, 32 nt, Human
uuuggguuaaggcuggacaucaauuagugagc

SEQ ID NO: 546832 - RNA, 32 nt, Human
uuuggguuaccucccugagucuguaagcaacc

SEQ ID NO: 546833 - RNA, 32 nt, Human
uuuggguuaggaucuucucuccccuaaagcau

SEQ ID NO: 546834 - RNA, 32 nt, Human
uuuggguugcaugccuguaaucccagcauuuu

SEQ ID NO: 546835 - RNA, 32 nt, Human
uuuggguuuauuuggaaaggaaugcaaagaug

SEQ ID NO: 546836 - RNA, 21 nt, Human
uuugguaaauguagacugugc

SEQ ID NO: 546837 - RNA, 22 nt, Human
uuugguaaccgaacuggugcuu

SEQ ID NO: 546838 - RNA, 32 nt, Human
uuugguaaugaguuuacagagagugggucauc

SEQ ID NO: 546839 - RNA, 32 nt, Human
uuugguaccaguaccaugauguuuugguuacu

SEQ ID NO: 546840 - RNA, 32 nt, Human
uuugguaccaguaccaugcuguuuugguuacu

SEQ ID NO: 546841 - RNA, 32 nt, Human
uuugguacucuuaaagcuucaguggccuagca

SEQ ID NO: 546842 - RNA, 32 nt, Human
uuugguacugcaacugcuuuccucuugcccag

SEQ ID NO: 546843 - RNA, 32 nt, Human
uuugguacuuuagaaauguaacuuuuugcucu

SEQ ID NO: 546844 - RNA, 32 nt, Human
uuugguagacgggguuucaccaugugggccag

SEQ ID NO: 546845 - RNA, 32 nt, Human
uuugguagcagcucccugccuccagggcuucc

SEQ ID NO: 546846 - RNA, 19 nt, Human
uuugguaggaaagggucag

SEQ ID NO: 546847 - RNA, 32 nt, Human
uuugguaguauuaauuuuguggucauuguuuc

SEQ ID NO: 546848 - RNA, 32 nt, Human
uuugguagucaguguggccugcucugaaucag

SEQ ID NO: 546849 - RNA, 32 nt, Human
uuugguaucugugugacugcucugugcccauc

SEQ ID NO: 546850 - RNA, 31 nt, Human
uuugguaugagauucucugccaacaccaagc

SEQ ID NO: 546851 - RNA, 32 nt, Human
uuugguauugauuucacagucagcugcucaac

SEQ ID NO: 546852 - RNA, 32 nt, Human
uuuggucaaccaggaccuugauuuuucaggca

SEQ ID NO: 546853 - RNA, 32 nt, Human
uuuggucacacucucaccuaggugagcgcauu

SEQ ID NO: 546854 - RNA, 32 nt, Human
uuuggucacagaggcagauguacagagggaag

SEQ ID NO: 546855 - RNA, 32 nt, Human
uuuggucacccagauaugaguauuaauguugg

SEQ ID NO: 546856 - RNA, 21 nt, Human
uuuggucacuguccuuuuaaa

SEQ ID NO: 546857 - RNA, 32 nt, Human
uuuggucacuuccaagcuagaaggaggaauca

SEQ ID NO: 546858 - RNA, 19 nt, Human
uuuggucagccugcugaca

SEQ ID NO: 546859 - RNA, 32 nt, Human
uuuggucaggaguucaagaccacccuggccaa

SEQ ID NO: 546860 - RNA, 32 nt, Human
uuugguccagccugguuuagccuggauguugc

SEQ ID NO: 546861 - RNA, 32 nt, Human
uuugguccauguccgaguccggccuuuggagu

SEQ ID NO: 546862 - RNA, 32 nt, Human
uuugguccccuaaucccagagcagaaaagaaa

SEQ ID NO: 546863 - RNA, 32 nt, Human
uuuggucccuggcucucccagagggacauggc

SEQ ID NO: 546864 - RNA, 32 nt, Human
uuugguccugccuuccccagagcugcuagcag

SEQ ID NO: 546865 - RNA, 32 nt, Human
uuugguccugcuaguuucuggauuguacaaau

SEQ ID NO: 546866 - RNA, 32 nt, Human
uuugguccuucuguuacccagcuccuggaggc

SEQ ID NO: 546867 - RNA, 32 nt, Human
uuuggucgaaggugccugguuuagugcuguaa

SEQ ID NO: 546868 - RNA, 32 nt, Human
uuuggucgugucguuuguaugaaaaucugagg

SEQ ID NO: 546869 - RNA, 32 nt, Human
uuuggucuagacuaggcuuugggugguuccaa

SEQ ID NO: 546870 - RNA, 32 nt, Human
uuuggucucauaccugcgucuaccuuccaucu

SEQ ID NO: 546871 - RNA, 32 nt, Human
uuuggucucugacuucugcuugauuccacagu

SEQ ID NO: 546872 - RNA, 32 nt, Human
uuuggucucugccuuuucaaauugcaguugaa

SEQ ID NO: 546873 - RNA, 32 nt, Human
uuuggucuguuaccuguuuuccagaaauuugu

SEQ ID NO: 546874 - RNA, 32 nt, Human
uuuggucuguucugugacucucuccccaaaca

SEQ ID NO: 546875 - RNA, 32 nt, Human
uuuggucuguuuuugggaaaaguuuucaagag

SEQ ID NO: 546876 - RNA, 32 nt, Human
uuuggucuuagcacuuuccuucuccagauccc

SEQ ID NO: 546877 - RNA, 32 nt, Human
uuuggucuucuaaaaugggaucaugcccauuu

SEQ ID NO: 546878 - RNA, 22 nt, Human
uuuggugacccugucuuucuua

SEQ ID NO: 546879 - RNA, 32 nt, Human
uuuggugagcagcagcccuggggucacagaca

SEQ ID NO: 546880 - RNA, 23 nt, Human
uuuggugaggggugggggugcgg

SEQ ID NO: 546881 - RNA, 32 nt, Human
uuuggugaguguaagggauucugcaagggaca

SEQ ID NO: 546882 - RNA, 32 nt, Human
uuuggugaugaggacauggaagggcaggcaga

SEQ ID NO: 546883 - RNA, 32 nt, Human
uuuggugaugcuguucuugggucuaccacacc

SEQ ID NO: 546884 - RNA, 23 nt, Human
uuuggugaugcuuauuuuugcca

SEQ ID NO: 546885 - RNA, 32 nt, Human
uuuggugcacacuggagcuacuuggacaagac

SEQ ID NO: 546886 - RNA, 32 nt, Human
uuuggugcagagaaguuagauccugcuaaauu

SEQ ID NO: 546887 - RNA, 32 nt, Human
uuuggugcaguuucagcucacugcaaccuccg

SEQ ID NO: 546888 - RNA, 23 nt, Human
uuuggugcauuuuuaguugggaa

SEQ ID NO: 546889 - RNA, 32 nt, Human
uuuggugcucuauugauuggugagugaccaga

SEQ ID NO: 546890 - RNA, 32 nt, Human
uuuggugcucucuugccuuuagcuaccuucuc

SEQ ID NO: 546891 - RNA, 32 nt, Human
uuuggugcuggguucucacauccaaguguucc

SEQ ID NO: 546892 - RNA, 32 nt, Human
uuugguggaagugggccuugaacacaguguac

SEQ ID NO: 546893 - RNA, 32 nt, Human
uuugguggagccgccagcugacaggacaucuu

SEQ ID NO: 546894 - RNA, 32 nt, Human
uuugguggcaccacugcccuccagccuggaug

SEQ ID NO: 546895 - RNA, 32 nt, Human
uuugguggcaugcaccuguaaucccagcuacu

SEQ ID NO: 546896 - RNA, 32 nt, Human
uuugguggcgcaugcuuguaaucccagcuacu

SEQ ID NO: 546897 - RNA, 32 nt, Human
uuugguggcugaggcaugagaaucacuugaac

SEQ ID NO: 546898 - RNA, 32 nt, Human
uuuggugggcaaguggggcugauggugguguc

SEQ ID NO: 546899 - RNA, 32 nt, Human
uuuggugggcaagugggggugaucuugguguu

SEQ ID NO: 546900 - RNA, 20 nt, Human
uuugguggggcggggggcgg

SEQ ID NO: 546901 - RNA, 32 nt, Human
uuuggugggggcagauggcagggcgacccaaa

SEQ ID NO: 546902 - RNA, 23 nt, Human
uuuggugggguggugggaugcag

SEQ ID NO: 546903 - RNA, 32 nt, Human
uuugguggugcacaccuguagucccagcuacu

SEQ ID NO: 546904 - RNA, 32 nt, Human
uuugguggugcaugccuguaaucccagcuacu

SEQ ID NO: 546905 - RNA, 32 nt, Human
uuugguggugugcgccuguaaucccagcuacu

SEQ ID NO: 546906 - RNA, 32 nt, Human
uuuggugguuaagguuugugauaaagaguuuu

SEQ ID NO: 546907 - RNA, 32 nt, Human
uuugguguauagaaguuuguccauuuguaaaa

SEQ ID NO: 546908 - RNA, 32 nt, Human
uuugguguauuggcaugaagcuacuuacagua

SEQ ID NO: 546909 - RNA, 32 nt, Human
uuuggugucauuauuccaucuucuccauaagu

SEQ ID NO: 546910 - RNA, 32 nt, Human
uuugguguccaugcuuuucacucugaggacau

SEQ ID NO: 546911 - RNA, 29 nt, Human
uuuggugucugaugugugcccagaucguu

SEQ ID NO: 546912 - RNA, 32 nt, Human
uuuggugucuuuuuauaauucgcucgugguca

SEQ ID NO: 546913 - RNA, 32 nt, Human
uuuggugugaucuagcaaaagaguaggaauca

SEQ ID NO: 546914 - RNA, 32 nt, Human
uuuggugugcugcuucccaugcacuacuuuga

SEQ ID NO: 546915 - RNA, 32 nt, Human
uuugguguucgaggagggacaggacagcuggc

SEQ ID NO: 546916 - RNA, 32 nt, Human
uuugguguuggugcuuguaagcauuuucauua

SEQ ID NO: 546917 - RNA, 25 nt, Human
uuugguguugucuugguuuuucuca

SEQ ID NO: 546918 - RNA, 32 nt, Human
uuugguguuuugcuguugagcugguuuuugag

SEQ ID NO: 546919 - RNA, 32 nt, Human
uuugguuaaaucaugccaucugaacagaaaca

SEQ ID NO: 546920 - RNA, 18 nt, Human
uuugguuagucagaguga

SEQ ID NO: 546921 - RNA, 32 nt, Human
uuugguuaguguugaaggugggaagagcauuu

SEQ ID NO: 546922 - RNA, 32 nt, Human
uuugguuaugcugaauuugaggaccuggauuc

SEQ ID NO: 546923 - RNA, 32 nt, Human
uuugguuauuuuucugucaucaaacaaaaaca

SEQ ID NO: 546924 - RNA, 32 nt, Human
uuugguucagaauauuguuugugccaguacau

SEQ ID NO: 546925 - RNA, 32 nt, Human
uuugguuccagaaggaacugucagucaucagc

SEQ ID NO: 546926 - RNA, 32 nt, Human
uuugguucccacucagcuucugccggucggca

SEQ ID NO: 546927 - RNA, 32 nt, Human
uuugguucccuaguuaacuucucuucauccuu

SEQ ID NO: 546928 - RNA, 32 nt, Human
uuugguucucugcugugccugccuguguccug

SEQ ID NO: 546929 - RNA, 22 nt, Human
uuugguucugaagcugguccuu

SEQ ID NO: 546930 - RNA, 21 nt, Human
uuugguugcuuucuugccaaa

SEQ ID NO: 546931 - RNA, 32 nt, Human
uuugguugggggaaggaagaggccaauuucau

SEQ ID NO: 546932 - RNA, 32 nt, Human
uuugguuuacuugucugucaaauguuuccuua

SEQ ID NO: 546933 - RNA, 32 nt, Human
uuugguuucauauugaauaaaucauugccaaa

SEQ ID NO: 546934 - RNA, 32 nt, Human
uuugguuucuuccuuuacuauagaugauugug

SEQ ID NO: 546935 - RNA, 32 nt, Human
uuugguuugguucauggggucucugccuaugg

SEQ ID NO: 546936 - RNA, 32 nt, Human
uuugguuuucaccaccaugacaggacaaugau

SEQ ID NO: 546937 - RNA, 32 nt, Human
uuugguuuucuacuccuccucagccucauaaa

SEQ ID NO: 546938 - RNA, 32 nt, Human
uuugguuuugaaacggagucucgcucugucgc

SEQ ID NO: 546939 - RNA, 31 nt, Human
uuugguuuugagaaaagauggugaaguuucu

SEQ ID NO: 546940 - RNA, 32 nt, Human
uuugguuuuguuccuuucauccugucuguguu

SEQ ID NO: 546941 - RNA, 32 nt, Human
uuugguuuuuguaaacggagaggacaguucuu

SEQ ID NO: 546942 - RNA, 32 nt, Human
uuuguaaaaccauccccuucaccagaauggua

SEQ ID NO: 546943 - RNA, 22 nt, Human
uuuguaaaauaaaaccaccaaa

SEQ ID NO: 546944 - RNA, 23 nt, Human
uuuguaaacauuuuuaguuggaa

SEQ ID NO: 546945 - RNA, 32 nt, Human
uuuguaaaccugcagaacauuuuacuuaaaag

SEQ ID NO: 546946 - RNA, 32 nt, Human
uuuguaaagauaacagagugguggggucaaag

SEQ ID NO: 546947 - RNA, 32 nt, Human
uuuguaaagauuaccuugccacuuuauaagaa

SEQ ID NO: 546948 - RNA, 32 nt, Human
uuuguaaagucauuggauauaaaagagugauu

SEQ ID NO: 546949 - RNA, 32 nt, Human
uuuguaaauaaacgugcucucugaaugccaaa

SEQ ID NO: 546950 - RNA, 32 nt, Human
uuuguaaaucaaguauuacuggaacacaacca

SEQ ID NO: 546951 - RNA, 32 nt, Human
uuuguaaauggacauugaacaaacaaacuacc

SEQ ID NO: 546952 - RNA, 32 nt, Human
uuuguaaauuauauacauguacuacuguacua

SEQ ID NO: 546953 - RNA, 32 nt, Human
uuuguaacaaaggagucuguaacuuuauuuau

SEQ ID NO: 546954 - RNA, 32 nt, Human
uuuguaacaaaugaacgauauguagcagaaag

SEQ ID NO: 546955 - RNA, 32 nt, Human
uuuguaacacaaauaaaugcuugaggagaugg

SEQ ID NO: 546956 - RNA, 32 nt, Human
uuuguaacauacaaaaagaaucugccagaaaa

SEQ ID NO: 546957 - RNA, 23 nt, Human
uuuguaaccagccuggguaacac

SEQ ID NO: 546958 - RNA, 32 nt, Human
uuuguaaccaucauaauacagguguaauaggu

SEQ ID NO: 546959 - RNA, 32 nt, Human
uuuguaacccagagcauguucaauuuuuggaa

SEQ ID NO: 546960 - RNA, 18 nt, Human
uuuguaacccagccacca

SEQ ID NO: 546961 - RNA, 32 nt, Human
uuuguaacuuaguaaagguauuaacuuccuug

SEQ ID NO: 546962 - RNA, 32 nt, Human
uuuguaagcaucuggggagguacugaacugua

SEQ ID NO: 546963 - RNA, 32 nt, Human
uuuguaaggaagaucauaaaugcuaaaaauuc

SEQ ID NO: 546964 - RNA, 32 nt, Human
uuuguaaggacacucaucugugccccacgucc

SEQ ID NO: 546965 - RNA, 32 nt, Human
uuuguaaguaaguaagaaagaaggcaaauuga

SEQ ID NO: 546966 - RNA, 32 nt, Human
uuuguaagugagagagacaagaagcaaauuuu

SEQ ID NO: 546967 - RNA, 22 nt, Human
uuuguaauacugaauauaaaca

SEQ ID NO: 546968 - RNA, 32 nt, Human
uuuguaauagcaaugauucacacucacagcaa

SEQ ID NO: 546969 - RNA, 32 nt, Human
uuuguaaucccagcuacacaggaggcugaggc

SEQ ID NO: 546970 - RNA, 32 nt, Human
uuuguaaucugggaagugccugguuuugaaaa

SEQ ID NO: 546971 - RNA, 32 nt, Human
uuuguaaugaacacaagccucucuugaguaga

SEQ ID NO: 546972 - RNA, 32 nt, Human
uuuguaaugacagggucuccauauguugccca

SEQ ID NO: 546973 - RNA, 32 nt, Human
uuuguacaacccugacccguuugcuacaucuu

SEQ ID NO: 546974 - RNA, 32 nt, Human
uuuguacacauacacaaaauguaccauuuuaa

SEQ ID NO: 546975 - RNA, 32 nt, Human
uuuguacaccuucuguuucuuugcuuauuuuu

SEQ ID NO: 546976 - RNA, 32 nt, Human
uuuguacagagcagugcacucuaaccuaugcc

SEQ ID NO: 546977 - RNA, 32 nt, Human
uuuguacagcacagaacucacacagaggaaaa

SEQ ID NO: 546978 - RNA, 32 nt, Human
uuuguacaggaauaaacacaccuacgcuccga

SEQ ID NO: 546979 - RNA, 32 nt, Human
uuuguacaggccgccucccuucccgguccggg

SEQ ID NO: 546980 - RNA, 31 nt, Human
uuuguacaguguuagaauacugugaaggcaa

SEQ ID NO: 546981 - RNA, 32 nt, Human
uuuguacaguuccucaugaaguugcaucugag

SEQ ID NO: 546982 - RNA, 32 nt, Human
uuuguacauauguguguauauguauauacaug

SEQ ID NO: 546983 - RNA, 32 nt, Human
uuuguacaugcaucugcauucagcugauggcu

SEQ ID NO: 546984 - RNA, 32 nt, Human
uuuguacaugcuacaauaaaugcagcuggcag

SEQ ID NO: 546985 - RNA, 32 nt, Human
uuuguacauugcacagaaacuugugugggugc

SEQ ID NO: 546986 - RNA, 32 nt, Human
uuuguacauuuuaccacuuaaacaguaaaucu

SEQ ID NO: 546987 - RNA, 24 nt, Human
uuuguaccaagcuacaucgcagug

SEQ ID NO: 546988 - RNA, 32 nt, Human
uuuguaccacuuuuagaagauaccagaugccu

SEQ ID NO: 546989 - RNA, 32 nt, Human
uuuguaccaguggaacuuuuuauacuggagau

SEQ ID NO: 546990 - RNA, 32 nt, Human
uuuguaccgugccguggagugagaggcuccuc

SEQ ID NO: 546991 - RNA, 32 nt, Human
uuuguaccuaugugacagacauuuucaauaau

SEQ ID NO: 546992 - RNA, 32 nt, Human
uuuguaccuggugucuuuuauuaagaauuuac

SEQ ID NO: 546993 - RNA, 32 nt, Human
uuuguaccuuucucacggcacagcguguggcc

SEQ ID NO: 546994 - RNA, 32 nt, Human
uuuguacggaauagauaauuaagagugaagga

SEQ ID NO: 546995 - RNA, 32 nt, Human
uuuguacuaugcuggggcuauuguuaggaguu

SEQ ID NO: 546996 - RNA, 32 nt, Human
uuuguacucaccaggcuggagugugguagcac

SEQ ID NO: 546997 - RNA, 32 nt, Human
uuuguacucaggagucugacuccuggguucua

SEQ ID NO: 546998 - RNA, 32 nt, Human
uuuguacugccucucccgccuguggccaaagu

SEQ ID NO: 546999 - RNA, 32 nt, Human
uuuguacugccugguaugucuguguaauaagc

SEQ ID NO: 547000 - RNA, 32 nt, Human
uuuguacuggucuccuucucuccuuuccaccg

SEQ ID NO: 547001 - RNA, 32 nt, Human
uuuguacuguguugugcuugcugucucucccg

SEQ ID NO: 547002 - RNA, 32 nt, Human
uuuguacuguuuaggucgacgugaggacauca

SEQ ID NO: 547003 - RNA, 32 nt, Human
uuuguacuuuggugggggauucguggaucuuu

SEQ ID NO: 547004 - RNA, 32 nt, Human
uuuguagaaacagggucucaccauguugucca

SEQ ID NO: 547005 - RNA, 32 nt, Human
uuuguagaaacagggucuugcuauguugccca

SEQ ID NO: 547006 - RNA, 23 nt, Human
uuuguagaagaugccuuucuucc

SEQ ID NO: 547007 - RNA, 32 nt, Human
uuuguagaaucccagccccagcaucuccaagc

SEQ ID NO: 547008 - RNA, 32 nt, Human
uuuguagacacagggucucgcuguguugccca

SEQ ID NO: 547009 - RNA, 21 nt, Human
uuuguagaccacguaaccuuc

SEQ ID NO: 547010 - RNA, 32 nt, Human
uuuguagagacagaguuucacuguguuagcca

SEQ ID NO: 547011 - RNA, 32 nt, Human
uuuguagagacagaguuucgucauguugccca

SEQ ID NO: 547012 - RNA, 32 nt, Human
uuuguagagacaggagucuugccauguugccc

SEQ ID NO: 547013 - RNA, 32 nt, Human
uuuguagagacaggaucucacuauguugccca

SEQ ID NO: 547014 - RNA, 32 nt, Human
uuuguagagacagggcuucaccauguugccaa

SEQ ID NO: 547015 - RNA, 32 nt, Human
uuuguagagacagggucccacuauguugcuca

SEQ ID NO: 547016 - RNA, 32 nt, Human
uuuguagagacagggucucaccaugucaccca

SEQ ID NO: 547017 - RNA, 32 nt, Human
uuuguagagacagggucucacuauguugccca

SEQ ID NO: 547018 - RNA, 32 nt, Human
uuuguagagacagggucucacuguguugccca

SEQ ID NO: 547019 - RNA, 32 nt, Human
uuuguagagacagggucucacuguguugccuc

SEQ ID NO: 547020 - RNA, 32 nt, Human
uuuguagagacagggucucacuuuguugccca

SEQ ID NO: 547021 - RNA, 32 nt, Human
uuuguagagacagggucucccuguguugacca

SEQ ID NO: 547022 - RNA, 32 nt, Human
uuuguagagacagggucucgccauguugccca

SEQ ID NO: 547023 - RNA, 32 nt, Human
uuuguagagacagggucuucccauguugccca

SEQ ID NO: 547024 - RNA, 32 nt, Human
uuuguagagacagggucuugccauguugcccu

SEQ ID NO: 547025 - RNA, 32 nt, Human
uuuguagagacaggguuucaccauguugccca

SEQ ID NO: 547026 - RNA, 32 nt, Human
uuuguagagacaggguuucaccauguuggcca

SEQ ID NO: 547027 - RNA, 32 nt, Human
uuuguagagacaggguuucaccauguugguua

SEQ ID NO: 547028 - RNA, 32 nt, Human
uuuguagagacaggguuucgccauguuaucca

SEQ ID NO: 547029 - RNA, 32 nt, Human
uuuguagagacaggguuucgccauguugacga

SEQ ID NO: 547030 - RNA, 32 nt, Human
uuuguagagacaggguuucuccauguugccca

SEQ ID NO: 547031 - RNA, 32 nt, Human
uuuguagagacaggguuuugccauguugcuca

SEQ ID NO: 547032 - RNA, 32 nt, Human
uuuguagagacaggguuuugccauguugucca

SEQ ID NO: 547033 - RNA, 32 nt, Human
uuuguagagacaggguuuugcuaugcugccca

SEQ ID NO: 547034 - RNA, 32 nt, Human
uuuguagagacaggugucucucuacguugccc

SEQ ID NO: 547035 - RNA, 32 nt, Human
uuuguagagacaguguuuagccauguugccca

SEQ ID NO: 547036 - RNA, 32 nt, Human
uuuguagagacgagguuucaccauguugccca

SEQ ID NO: 547037 - RNA, 32 nt, Human
uuuguagagacgagguuucgccauguugccca

SEQ ID NO: 547038 - RNA, 32 nt, Human
uuuguagagacgggguuuuacuauguugccca

SEQ ID NO: 547039 - RNA, 32 nt, Human
uuuguagagagaaagccaggagguaagagcca

SEQ ID NO: 547040 - RNA, 32 nt, Human
uuuguagagaugaggucucccuauguugccca

SEQ ID NO: 547041 - RNA, 32 nt, Human
uuuguagagaugcagucuuacuauguugccca

SEQ ID NO: 547042 - RNA, 32 nt, Human
uuuguagagauggagucucccuauguugcuca

SEQ ID NO: 547043 - RNA, 32 nt, Human
uuuguagagauggggucucccuauguugccca

SEQ ID NO: 547044 - RNA, 32 nt, Human
uuuguagagauguguuuuuccauguugcccaa

SEQ ID NO: 547045 - RNA, 32 nt, Human
uuuguagagccagggucucacuauguugccca

SEQ ID NO: 547046 - RNA, 32 nt, Human
uuuguagaggaacagccagggaaggaacccuc

SEQ ID NO: 547047 - RNA, 32 nt, Human
uuuguagauaauaugcuggucagggcuggucu

SEQ ID NO: 547048 - RNA, 32 nt, Human
uuuguagauauaaggucucaugauauugccca

SEQ ID NO: 547049 - RNA, 24 nt, Human
uuuguagauuauuagugucuuucu

SEQ ID NO: 547050 - RNA, 21 nt, Human
uuuguagcacugcaaugcaga

SEQ ID NO: 547051 - RNA, 32 nt, Human
uuuguagcaguauuuuuauuagaaaagaaucu

SEQ ID NO: 547052 - RNA, 32 nt, Human
uuuguagcaguuguuugucucauuuuugcucu

SEQ ID NO: 547053 - RNA, 32 nt, Human
uuuguagccagccagcucccaggccaacgccc

SEQ ID NO: 547054 - RNA, 18 nt, Human
uuuguagccccagcccua

SEQ ID NO: 547055 - RNA, 25 nt, Human
uuuguagccucucuuuguuuuucuu

SEQ ID NO: 547056 - RNA, 32 nt, Human
uuuguagcucucucacagguagcuuaagcgag

SEQ ID NO: 547057 - RNA, 32 nt, Human
uuuguagcuuccucccuacucucuccaacacc

SEQ ID NO: 547058 - RNA, 32 nt, Human
uuuguaggaaggacagaguggagaggacagug

SEQ ID NO: 547059 - RNA, 32 nt, Human
uuuguaggaggaagaauaucaagguuguggaa

SEQ ID NO: 547060 - RNA, 32 nt, Human
uuuguaggaucacguuguccuuacgauacuga

SEQ ID NO: 547061 - RNA, 32 nt, Human
uuuguaggcagucaguuaccuucaccuuauga

SEQ ID NO: 547062 - RNA, 32 nt, Human
uuuguagggacagggucuugcucuguugccca

SEQ ID NO: 547063 - RNA, 32 nt, Human
uuuguaggugaaagguguagcagucacucggc

SEQ ID NO: 547064 - RNA, 32 nt, Human
uuuguaguaaccaagcaagcaucauaucuuaa

SEQ ID NO: 547065 - RNA, 32 nt, Human
uuuguaguacauccaucuugaguaaauuaagc

SEQ ID NO: 547066 - RNA, 32 nt, Human
uuuguagucagcaagcaaaguacugguccuuu

SEQ ID NO: 547067 - RNA, 32 nt, Human
uuuguagucugucagugucucuuauaaauugc

SEQ ID NO: 547068 - RNA, 32 nt, Human
uuuguaguucagaaagugaggcucaaagaauu

SEQ ID NO: 547069 - RNA, 32 nt, Human
uuuguaguuccuauuucuguggguuugccugg

SEQ ID NO: 547070 - RNA, 32 nt, Human
uuuguaguugaauauuggccaaggaaaggcac

SEQ ID NO: 547071 - RNA, 32 nt, Human
uuuguaguuuguucauucauccauccaccugu

SEQ ID NO: 547072 - RNA, 32 nt, Human
uuuguauaacuaugcagccuucccucucuuuc

SEQ ID NO: 547073 - RNA, 22 nt, Human
uuuguauagcucuucugcccca

SEQ ID NO: 547074 - RNA, 32 nt, Human
uuuguauaguuacuauccugugcagcagcugg

SEQ ID NO: 547075 - RNA, 32 nt, Human
uuuguauauaaauauguaaauacaugcuuuaa

SEQ ID NO: 547076 - RNA, 32 nt, Human
uuuguauaucaaaaucauguaguuuguauaaa

SEQ ID NO: 547077 - RNA, 32 nt, Human
uuuguauauguacuugcuuuaucucuuuaccc

SEQ ID NO: 547078 - RNA, 32 nt, Human
uuuguauauuguaggaaucccuuugagaaugu

SEQ ID NO: 547079 - RNA, 23 nt, Human
uuuguauauuucucuuugucaga

SEQ ID NO: 547080 - RNA, 32 nt, Human
uuuguauauuuuuauagguuagauuuguaaag

SEQ ID NO: 547081 - RNA, 32 nt, Human
uuuguaucaauccauuuucacacugcuauaag

SEQ ID NO: 547082 - RNA, 32 nt, Human
uuuguaucaccuuugcuaucuuggggaaagug

SEQ ID NO: 547083 - RNA, 32 nt, Human
uuuguaucagcagaacaguaguggacucgacu

SEQ ID NO: 547084 - RNA, 32 nt, Human
uuuguaucaguaucauuugaucugccauggac

SEQ ID NO: 547085 - RNA, 32 nt, Human
uuuguauccauucauuacuuuccucuuuucaa

SEQ ID NO: 547086 - RNA, 32 nt, Human
uuuguaucccugcuuauugcaccugacgacua

SEQ ID NO: 547087 - RNA, 32 nt, Human
uuuguauccuuccuagagacaggauuucgcca

SEQ ID NO: 547088 - RNA, 32 nt, Human
uuuguaucuccuggggagcuuuuaaagaguac

SEQ ID NO: 547089 - RNA, 32 nt, Human
uuuguaugaacuucuggaucuccagucagaua

SEQ ID NO: 547090 - RNA, 23 nt, Human
uuuguaugacucguuuguucuuu

SEQ ID NO: 547091 - RNA, 21 nt, Human
uuuguaugagaaauaaacgua

SEQ ID NO: 547092 - RNA, 29 nt, Human
uuuguaugucuguguauguauaggggaaa

SEQ ID NO: 547093 - RNA, 32 nt, Human
uuuguauuccauacuaaagccaugaagaacua

SEQ ID NO: 547094 - RNA, 32 nt, Human
uuuguauugggagcucuggaccaauagugucu

SEQ ID NO: 547095 - RNA, 32 nt, Human
uuuguauuuaacuaccugcuucccaggcgucc

SEQ ID NO: 547096 - RNA, 32 nt, Human
uuuguauuuacacuacagauuggugaauuugc

SEQ ID NO: 547097 - RNA, 32 nt, Human
uuuguauuuccagagagaaugucuuuuagauu

SEQ ID NO: 547098 - RNA, 32 nt, Human
uuuguauuuccccuggacaaaaugauaccuaa

SEQ ID NO: 547099 - RNA, 32 nt, Human
uuuguauuugaaucuuugccucgggaucuacu

SEQ ID NO: 547100 - RNA, 32 nt, Human
uuuguauuuggucccaguuggguacauuuuaa

SEQ ID NO: 547101 - RNA, 32 nt, Human
uuuguauuuugcuacugaucugugaucaacca

SEQ ID NO: 547102 - RNA, 32 nt, Human
uuuguauuuuguaggauugaucuuauuuugag

SEQ ID NO: 547103 - RNA, 32 nt, Human
uuuguauuuuuagcagagacagggaggaaguu

SEQ ID NO: 547104 - RNA, 32 nt, Human
uuuguauuuuuagcagagacaggguuucacca

SEQ ID NO: 547105 - RNA, 32 nt, Human
uuuguauuuuuagcagagacaggguuucaccg

SEQ ID NO: 547106 - RNA, 32 nt, Human
uuuguauuuuuagcagagacgggguuucaccg

SEQ ID NO: 547107 - RNA, 32 nt, Human
uuuguauuuuuagcagagauggggguuucacc

SEQ ID NO: 547108 - RNA, 32 nt, Human
uuuguauuuuuagcagagaugggguuucacca

SEQ ID NO: 547109 - RNA, 32 nt, Human
uuuguauuuuuagcagagaugggguuucaccg

SEQ ID NO: 547110 - RNA, 32 nt, Human
uuuguauuuuuagcagagaugggguuuuacca

SEQ ID NO: 547111 - RNA, 32 nt, Human
uuuguauuuuuaguaaagaugggguuucacca

SEQ ID NO: 547112 - RNA, 32 nt, Human
uuuguauuuuuaguagagauggaguuucacca

SEQ ID NO: 547113 - RNA, 32 nt, Human
uuuguauuuuuaguagagauggaguuucacua

SEQ ID NO: 547114 - RNA, 32 nt, Human
uuuguauuuuuaguagagauggaguuuuacua

SEQ ID NO: 547115 - RNA, 32 nt, Human
uuuguauuuuuggcagagaugggguuucacca

SEQ ID NO: 547116 - RNA, 32 nt, Human
uuugucaaaacaaaugcuguacuccaauuuuc

SEQ ID NO: 547117 - RNA, 32 nt, Human
uuugucaaaaggaagucucuagguucugagcu

SEQ ID NO: 547118 - RNA, 32 nt, Human
uuugucaauuaggaauuuuccaggcaaugugu

SEQ ID NO: 547119 - RNA, 32 nt, Human
uuugucacagccggccuugcgaagccuccuca

SEQ ID NO: 547120 - RNA, 32 nt, Human
uuugucaccaggcuggagugcaguggugcaau

SEQ ID NO: 547121 - RNA, 32 nt, Human
uuugucacccaggcuggagugcaguggcacga

SEQ ID NO: 547122 - RNA, 32 nt, Human
uuugucacccaggcuggagugcaguggcauga

SEQ ID NO: 547123 - RNA, 32 nt, Human
uuugucacccaggcuggagugcaguggggcaa

SEQ ID NO: 547124 - RNA, 32 nt, Human
uuugucacccaggcuggagugcagugguguga

SEQ ID NO: 547125 - RNA, 32 nt, Human
uuugucaccgaggcuggagugcaauggcccga

SEQ ID NO: 547126 - RNA, 32 nt, Human
uuugucacuguucuauuagacuuuuuacugaa

SEQ ID NO: 547127 - RNA, 32 nt, Human
uuugucacuucccaguuugucuugucauucag

SEQ ID NO: 547128 - RNA, 24 nt, Human
uuugucagacauuccuguuuuucu

SEQ ID NO: 547129 - RNA, 32 nt, Human
uuugucagacugguagaaguugcuuugcauau

SEQ ID NO: 547130 - RNA, 32 nt, Human
uuugucagaguggggaaauaaaagggcuuuau

SEQ ID NO: 547131 - RNA, 32 nt, Human
uuugucagccaggcuggagugcagugacacga

SEQ ID NO: 547132 - RNA, 32 nt, Human
uuugucagcccgauuauuugcaaagaaaauau

SEQ ID NO: 547133 - RNA, 32 nt, Human
uuugucaggaagggaaggggcucaacacagug

SEQ ID NO: 547134 - RNA, 32 nt, Human
uuugucaggcugggcgcgguggcucacuccug

SEQ ID NO: 547135 - RNA, 32 nt, Human
uuugucaggcugggugcaguggcucaugccug

SEQ ID NO: 547136 - RNA, 32 nt, Human
uuugucagucucuucccucccccagucucucu

SEQ ID NO: 547137 - RNA, 32 nt, Human
uuugucauaacccuggucuggcugguuuugag

SEQ ID NO: 547138 - RNA, 32 nt, Human
uuugucaucucucaaauuagaauauaaauuuu

SEQ ID NO: 547139 - RNA, 32 nt, Human
uuugucaucuucacucuccacccccagagagg

SEQ ID NO: 547140 - RNA, 32 nt, Human
uuugucaugcagaugacuucagaccugauuaa

SEQ ID NO: 547141 - RNA, 32 nt, Human
uuuguccaaauuucugggcucagcgcuuggga

SEQ ID NO: 547142 - RNA, 32 nt, Human
uuuguccacacaagacagcagagccaucugcg

SEQ ID NO: 547143 - RNA, 32 nt, Human
uuuguccaccucuccuuuaucucuguuucucu

SEQ ID NO: 547144 - RNA, 32 nt, Human
uuuguccagguaacaacacuaaagacaacccu

SEQ ID NO: 547145 - RNA, 32 nt, Human
uuuguccauguguuaaauggccaucagcuuua

SEQ ID NO: 547146 - RNA, 32 nt, Human
uuuguccauucuaguggccaaacaguaacagu

SEQ ID NO: 547147 - RNA, 32 nt, Human
uuugucccaacaaccucuggccccagcacccc

SEQ ID NO: 547148 - RNA, 32 nt, Human
uuugucccacaaaaucacaggagcacuguaug

SEQ ID NO: 547149 - RNA, 32 nt, Human
uuugucccagaaugccuccugcagggauucuu

SEQ ID NO: 547150 - RNA, 32 nt, Human
uuugucccagacuuccccuugggaucagggcu

SEQ ID NO: 547151 - RNA, 32 nt, Human
uuugucccccaggcuggagugcagugguacaa

SEQ ID NO: 547152 - RNA, 32 nt, Human
uuuguccccuggcugcugcccucccauucucc

SEQ ID NO: 547153 - RNA, 32 nt, Human
uuugucccguguaagggaacagguguggggaa

SEQ ID NO: 547154 - RNA, 32 nt, Human
uuugucccuaugguagccucagucucuuuauc

SEQ ID NO: 547155 - RNA, 32 nt, Human
uuugucccucaaacuaacaccccacacugcuu

SEQ ID NO: 547156 - RNA, 32 nt, Human
uuugucccucccccgcuuccucccucugcggg

SEQ ID NO: 547157 - RNA, 23 nt, Human
uuugucccuggcggugagagccc

SEQ ID NO: 547158 - RNA, 23 nt, Human
uuugucccuggggcugauggccc

SEQ ID NO: 547159 - RNA, 31 nt, Human
uuugucccuuucagugggccuguggucucug

SEQ ID NO: 547160 - RNA, 20 nt, Human
uuugucccuuucugaccuca

SEQ ID NO: 547161 - RNA, 32 nt, Human
uuuguccgagccuguggucaaggcgcugacca

SEQ ID NO: 547162 - RNA, 32 nt, Human
uuuguccguccacucuacaaaguuuccuccuc

SEQ ID NO: 547163 - RNA, 32 nt, Human
uuuguccuaaaacaccugguaggaguguguga

SEQ ID NO: 547164 - RNA, 32 nt, Human
uuuguccuaagugguauguucaaggagccuau

SEQ ID NO: 547165 - RNA, 32 nt, Human
uuuguccucggaggaggaggccagggacagac

SEQ ID NO: 547166 - RNA, 32 nt, Human
uuuguccucugaugagaaucuaaugucgcugu

SEQ ID NO: 547167 - RNA, 32 nt, Human
uuuguccucugccucccucugcuguucuucua

SEQ ID NO: 547168 - RNA, 32 nt, Human
uuuguccugcugaaccacuccagccugcugcg

SEQ ID NO: 547169 - RNA, 32 nt, Human
uuuguccugcuucucacuugacauugcauuac

SEQ ID NO: 547170 - RNA, 32 nt, Human
uuuguccugcuucucacuugacauugcauuau

SEQ ID NO: 547171 - RNA, 32 nt, Human
uuuguccuggugcaguggggcagcccugcauc

SEQ ID NO: 547172 - RNA, 32 nt, Human
uuuguccuguguguguuuacaguauucaauuu

SEQ ID NO: 547173 - RNA, 32 nt, Human
uuuguccuuaggugugagguccaggguugcua

SEQ ID NO: 547174 - RNA, 22 nt, Human
uuuguccuucacgguaugccag

SEQ ID NO: 547175 - RNA, 22 nt, Human
uuuguccuucucugccuuucuc

SEQ ID NO: 547176 - RNA, 32 nt, Human
uuuguccuugccacagucacggggugcaugug

SEQ ID NO: 547177 - RNA, 32 nt, Human
uuugucgagaggauuuccugagacugguuugg

SEQ ID NO: 547178 - RNA, 32 nt, Human
uuugucgccaggcuggagugcaguggugccau

SEQ ID NO: 547179 - RNA, 32 nt, Human
uuugucgcccaggcuggagugcaguggcacaa

SEQ ID NO: 547180 - RNA, 32 nt, Human
uuugucgcccaggcuggagugcaguggcacga

SEQ ID NO: 547181 - RNA, 32 nt, Human
uuugucgcccaggcuggagugcaguggcagug

SEQ ID NO: 547182 - RNA, 32 nt, Human
uuugucgcccaggcuggagugcaguggcauga

SEQ ID NO: 547183 - RNA, 32 nt, Human
uuugucgcccaggcuggagugcaguggcguga

SEQ ID NO: 547184 - RNA, 32 nt, Human
uuugucgcccaggcuggagugcagugguguga

SEQ ID NO: 547185 - RNA, 32 nt, Human
uuugucgcccuggcuggagugcaguugcgcag

SEQ ID NO: 547186 - RNA, 32 nt, Human
uuugucguaaacauuaaagugcaggucaguga

SEQ ID NO: 547187 - RNA, 32 nt, Human
uuugucgugggacuucaggccacauuggcuug

SEQ ID NO: 547188 - RNA, 25 nt, Human
uuugucgugguuccugccuuucuca

SEQ ID NO: 547189 - RNA, 32 nt, Human
uuugucgugugcgauccucacacucaugaaca

SEQ ID NO: 547190 - RNA, 32 nt, Human
uuugucuacagagagaaaaauugccuucaucc

SEQ ID NO: 547191 - RNA, 32 nt, Human
uuugucuacggaagccucugggugacaaaagu

SEQ ID NO: 547192 - RNA, 32 nt, Human
uuugucuagauuucuuuugccucucucacuga

SEQ ID NO: 547193 - RNA, 32 nt, Human
uuugucuagggcuuccucuugagacccucuuc

SEQ ID NO: 547194 - RNA, 32 nt, Human
uuugucuauguauauuucuagauauugauuag

SEQ ID NO: 547195 - RNA, 32 nt, Human
uuugucucaucccauucugcgucaugcuugug

SEQ ID NO: 547196 - RNA, 32 nt, Human
uuugucucauuucuucccuuuguuccuuaguc

SEQ ID NO: 547197 - RNA, 32 nt, Human
uuugucuccaaagcccuucuucuuuccaccac

SEQ ID NO: 547198 - RNA, 32 nt, Human
uuugucuccagccccugguccccagcucuugc

SEQ ID NO: 547199 - RNA, 32 nt, Human
uuugucucuccucuaugcgugcccauugcaga

SEQ ID NO: 547200 - RNA, 32 nt, Human
uuugucucucuuucuuuucuccuuugauuaua

SEQ ID NO: 547201 - RNA, 32 nt, Human
uuugucucugacaauacuugguguuuuucccu

SEQ ID NO: 547202 - RNA, 32 nt, Human
uuugucucuguucacuacugcgauagaggaaa

SEQ ID NO: 547203 - RNA, 32 nt, Human
uuugucucuguucuaaaauggaggcaguaggg

SEQ ID NO: 547204 - RNA, 32 nt, Human
uuugucucuuucuuucuugucuuugcucuuug

SEQ ID NO: 547205 - RNA, 32 nt, Human
uuugucucuuuuccuuuuucuguauccuguga

SEQ ID NO: 547206 - RNA, 32 nt, Human
uuugucugcaagagcugccacgcccaguucua

SEQ ID NO: 547207 - RNA, 32 nt, Human
uuugucuggcugauucuguccucaaauaaagc

SEQ ID NO: 547208 - RNA, 32 nt, Human
uuugucugggaagcagggauugcugacaugua

SEQ ID NO: 547209 - RNA, 32 nt, Human
uuugucuggugcaugugaugaaaccugcagcu

SEQ ID NO: 547210 - RNA, 32 nt, Human
uuugucuguccucugcugaggcuacggccggg

SEQ ID NO: 547211 - RNA, 29 nt, Human
uuugucugucugugugucugugacaguca

SEQ ID NO: 547212 - RNA, 32 nt, Human
uuugucuguguccuaggucgguuucugccacu

SEQ ID NO: 547213 - RNA, 32 nt, Human
uuugucuuagggucaagugaucuuuaugggau

SEQ ID NO: 547214 - RNA, 32 nt, Human
uuugucuucaaacugugaagcauuuacagaaa

SEQ ID NO: 547215 - RNA, 32 nt, Human
uuugucuucacucaacgucagggugggggagu

SEQ ID NO: 547216 - RNA, 32 nt, Human
uuugucuucacuccauuauaaagguaaguuac

SEQ ID NO: 547217 - RNA, 32 nt, Human
uuugucuucaguauuaggucuccaacucuugu

SEQ ID NO: 547218 - RNA, 19 nt, Human
uuugucuuccagccugcca

SEQ ID NO: 547219 - RNA, 32 nt, Human
uuugucuuccauuccauuguuuugaaacucag

SEQ ID NO: 547220 - RNA, 32 nt, Human
uuugucuucuaugcucccuggcugcagauuaa

SEQ ID NO: 547221 - RNA, 32 nt, Human
uuugucuucucuguggaagacaggaggcuaca

SEQ ID NO: 547222 - RNA, 32 nt, Human
uuugucuugugcuccagcuggagcuuuggucc

SEQ ID NO: 547223 - RNA, 32 nt, Human
uuugucuugugucuugagagcuuggccuuaug

SEQ ID NO: 547224 - RNA, 19 nt, Human
uuugucuuucccgcggccc

SEQ ID NO: 547225 - RNA, 32 nt, Human
uuugucuuugggccugggcaggcuuaggauuu

SEQ ID NO: 547226 - RNA, 32 nt, Human
uuugucuuuucaucuuugugcauaacuuaccu

SEQ ID NO: 547227 - RNA, 32 nt, Human
uuugucuuuuggcuucucaguagcuaagggga

SEQ ID NO: 547228 - RNA, 32 nt, Human
uuugugaaaaccaguuugaugugcuaaaagua

SEQ ID NO: 547229 - RNA, 32 nt, Human
uuugugaaaaugucaaagagaaaacuuauaua

SEQ ID NO: 547230 - RNA, 32 nt, Human
uuugugaaagagaagccuaaauucagcaucuc

SEQ ID NO: 547231 - RNA, 32 nt, Human
uuugugaaaggcugcuggccuccaaaggagag

SEQ ID NO: 547232 - RNA, 32 nt, Human
uuugugaaauauaacuuacaaauaaguacuua

SEQ ID NO: 547233 - RNA, 32 nt, Human
uuugugaaaucaagauguuuuaaucacauuca

SEQ ID NO: 547234 - RNA, 32 nt, Human
uuugugaaaugcuuuuucuccauguauugaga

SEQ ID NO: 547235 - RNA, 32 nt, Human
uuugugaacaaaugagacaaggcugcaaauuc

SEQ ID NO: 547236 - RNA, 32 nt, Human
uuugugaacaucacugaagcucugaagcuuug

SEQ ID NO: 547237 - RNA, 32 nt, Human
uuugugaacuuguauauuacaggaaacaagau

SEQ ID NO: 547238 - RNA, 32 nt, Human
uuugugaagauguguaagcaggauccgagcgu

SEQ ID NO: 547239 - RNA, 32 nt, Human
uuugugaaggcucugccagacaccuccaagcu

SEQ ID NO: 547240 - RNA, 32 nt, Human
uuugugaaggucagagaugcuuugccagucuc

SEQ ID NO: 547241 - RNA, 32 nt, Human
uuugugaaugaccuugguaacagaacaguugg

SEQ ID NO: 547242 - RNA, 23 nt, Human
uuugugaauuucccauggcccca

SEQ ID NO: 547243 - RNA, 32 nt, Human
uuugugaauuuggcuucauuuuacuuauacau

SEQ ID NO: 547244 - RNA, 32 nt, Human
uuugugaauuuggcuuccuuuuacuuauacau

SEQ ID NO: 547245 - RNA, 32 nt, Human
uuugugaccaagcagccucucccuucacccag

SEQ ID NO: 547246 - RNA, 23 nt, Human
uuugugaccacaaaaaugucucu

SEQ ID NO: 547247 - RNA, 24 nt, Human
uuugugaccagccugaccaacaua

SEQ ID NO: 547248 - RNA, 32 nt, Human
uuugugaccagccugaccaacauagugaaacc

SEQ ID NO: 547249 - RNA, 32 nt, Human
uuugugaccagccuggccaacauagugaaauc

SEQ ID NO: 547250 - RNA, 23 nt, Human
uuugugaccguucuugucuuucu

SEQ ID NO: 547251 - RNA, 32 nt, Human
uuugugacugacuggugucuucccauuuggac

SEQ ID NO: 547252 - RNA, 32 nt, Human
uuugugacuggcuucauuuacuuagcauauug

SEQ ID NO: 547253 - RNA, 32 nt, Human
uuugugacuuggcaggaccaggaaacagcagc

SEQ ID NO: 547254 - RNA, 32 nt, Human
uuugugagaagaaagucccugccccucccucg

SEQ ID NO: 547255 - RNA, 32 nt, Human
uuugugagauggggucucgcacugucccccag

SEQ ID NO: 547256 - RNA, 32 nt, Human
uuugugagcaugggugugcccuugggguaagc

SEQ ID NO: 547257 - RNA, 32 nt, Human
uuugugagguguaaaaccugcaugaaggaccc

SEQ ID NO: 547258 - RNA, 32 nt, Human
uuugugaguaaaagaggagcccagggagacag

SEQ ID NO: 547259 - RNA, 32 nt, Human
uuugugaguagaaagacuuuagguaauggaaa

SEQ ID NO: 547260 - RNA, 32 nt, Human
uuugugaguaggagagcugauaccucacauuc

SEQ ID NO: 547261 - RNA, 32 nt, Human
uuugugagucaauacauagugcugcugugugc

SEQ ID NO: 547262 - RNA, 32 nt, Human
uuugugagugcgggcaagucacucagccuccc

SEQ ID NO: 547263 - RNA, 32 nt, Human
uuugugaguggugucuuugagauacugauggc

SEQ ID NO: 547264 - RNA, 32 nt, Human
uuugugauaaagaaugugaacaguuguuagau

SEQ ID NO: 547265 - RNA, 32 nt, Human
uuugugauacuuccugugcucccucagagaga

SEQ ID NO: 547266 - RNA, 32 nt, Human
uuugugaugggcuucucucagcgguagcucag

SEQ ID NO: 547267 - RNA, 32 nt, Human
uuugugauucccucagaucugcccuaaucccg

SEQ ID NO: 547268 - RNA, 32 nt, Human
uuugugauuuccucugaugcaggagaggaaaa

SEQ ID NO: 547269 - RNA, 32 nt, Human
uuugugcaaaauauacauauaaacagaguaag

SEQ ID NO: 547270 - RNA, 32 nt, Human
uuugugcacaacuucagccacaauucaugggg

SEQ ID NO: 547271 - RNA, 32 nt, Human
uuugugcaccacuacugcagucgguacagaac

SEQ ID NO: 547272 - RNA, 32 nt, Human
uuugugcacuugcuuaguggauuguauuggau

SEQ ID NO: 547273 - RNA, 32 nt, Human
uuugugcagaucuuuaacauguuagugaacag

SEQ ID NO: 547274 - RNA, 32 nt, Human
uuugugcaggucacaugcccacugcagcccuc

SEQ ID NO: 547275 - RNA, 32 nt, Human
uuugugcauauguaccauugugcauguugcug

SEQ ID NO: 547276 - RNA, 32 nt, Human
uuugugcaucucuuaaggagguuuuuaaaauc

SEQ ID NO: 547277 - RNA, 32 nt, Human
uuugugcauuaauacauuacaaacaugaagau

SEQ ID NO: 547278 - RNA, 32 nt, Human
uuugugcauuuggaagugacaucgcugugugg

SEQ ID NO: 547279 - RNA, 32 nt, Human
uuugugccacaucuuccaacugagucuccccc

SEQ ID NO: 547280 - RNA, 32 nt, Human
uuugugccacugguucagcuguuagcacagua

SEQ ID NO: 547281 - RNA, 32 nt, Human
uuugugccagcaucugcugucagguggcucag

SEQ ID NO: 547282 - RNA, 32 nt, Human
uuugugcccagacuguuuuccucucucuuucc

SEQ ID NO: 547283 - RNA, 19 nt, Human
uuugugcccagcaagcugu

SEQ ID NO: 547284 - RNA, 32 nt, Human
uuugugcccuacuuuucuucuuguagggcuug

SEQ ID NO: 547285 - RNA, 32 nt, Human
uuugugccuaugccuucucucuccucagacag

SEQ ID NO: 547286 - RNA, 32 nt, Human
uuugugccuauguacauguguaaacaugccau

SEQ ID NO: 547287 - RNA, 32 nt, Human
uuugugccucacacuccagccuggguaacaga

SEQ ID NO: 547288 - RNA, 32 nt, Human
uuugugccuccccuuagucccuucccucccga

SEQ ID NO: 547289 - RNA, 32 nt, Human
uuugugccuggcuucuuucacuuaacauuaua

SEQ ID NO: 547290 - RNA, 32 nt, Human
uuugugccuugcacuccaugcauucugauaac

SEQ ID NO: 547291 - RNA, 32 nt, Human
uuugugcuaagcugauaaguaucaaacgauga

SEQ ID NO: 547292 - RNA, 32 nt, Human
uuugugcuagagcgagacccacacaacaacag

SEQ ID NO: 547293 - RNA, 23 nt, Human
uuugugcucacacccagcacgga

SEQ ID NO: 547294 - RNA, 32 nt, Human
uuugugcucaggcuggggaacagagaggcacg

SEQ ID NO: 547295 - RNA, 32 nt, Human
uuugugcucaugggaagcucuuuaagcaccug

SEQ ID NO: 547296 - RNA, 21 nt, Human
uuugugcuccccuuugccuaa

SEQ ID NO: 547297 - RNA, 20 nt, Human
uuugugcucccgcuuccuaa

SEQ ID NO: 547298 - RNA, 24 nt, Human
uuugugcucccucacucccuaaua

SEQ ID NO: 547299 - RNA, 32 nt, Human
uuugugcucuacuguuacuaggcuauuaauuu

SEQ ID NO: 547300 - RNA, 31 nt, Human
uuugugcucugaguuuugcuguugaaagucu

SEQ ID NO: 547301 - RNA, 32 nt, Human
uuugugcucugauaaauuguguucuguuaaag

SEQ ID NO: 547302 - RNA, 32 nt, Human
uuugugcucuucuguuccaaggaccacaggua

SEQ ID NO: 547303 - RNA, 23 nt, Human
uuugugcugaagaaaaacuuuac

SEQ ID NO: 547304 - RNA, 25 nt, Human
uuugugcugauuaacaccccuaaua

SEQ ID NO: 547305 - RNA, 32 nt, Human
uuugugcugcugcuguuauucaaagaucaaag

SEQ ID NO: 547306 - RNA, 32 nt, Human
uuugugcugggaacugaaagaguggggaaggu

SEQ ID NO: 547307 - RNA, 32 nt, Human
uuugugcuguguauaucacugcuuuauauaag

SEQ ID NO: 547308 - RNA, 32 nt, Human
uuugugcuucaaggagaugauaccugucaucc

SEQ ID NO: 547309 - RNA, 32 nt, Human
uuugugcuuccucuuucuccagaagccuucug

SEQ ID NO: 547310 - RNA, 32 nt, Human
uuugugcuucucuucagccccuucccuguguc

SEQ ID NO: 547311 - RNA, 32 nt, Human
uuugugcuugaacccagggcugugcuggugua

SEQ ID NO: 547312 - RNA, 32 nt, Human
uuugugcuuuggguuucuuuguugacugaaaa

SEQ ID NO: 547313 - RNA, 32 nt, Human
uuugugcuuuucucccugggccucauuuuaau

SEQ ID NO: 547314 - RNA, 32 nt, Human
uuuguggaagaaggacagggagcuagagccaa

SEQ ID NO: 547315 - RNA, 32 nt, Human
uuuguggacagguggccccuggagucaugccu

SEQ ID NO: 547316 - RNA, 32 nt, Human
uuuguggacuugucugaccaccuucuauuugc

SEQ ID NO: 547317 - RNA, 32 nt, Human
uuuguggagaggaggguguucuggccugagaa

SEQ ID NO: 547318 - RNA, 32 nt, Human
uuuguggaggcccauuuugcaaguggaaaccu

SEQ ID NO: 547319 - RNA, 32 nt, Human
uuuguggauaaggggccgggugcaguggcuca

SEQ ID NO: 547320 - RNA, 32 nt, Human
uuuguggauacagggucucauucuguugccua

SEQ ID NO: 547321 - RNA, 32 nt, Human
uuuguggaugaaucccacauuaggauggugaa

SEQ ID NO: 547322 - RNA, 32 nt, Human
uuuguggcauggauugcugugcucacugcugu

SEQ ID NO: 547323 - RNA, 32 nt, Human
uuuguggccagauuucaaauagggaguuaagu

SEQ ID NO: 547324 - RNA, 32 nt, Human
uuuguggccaggguuugugcagcagcuuugug

SEQ ID NO: 547325 - RNA, 32 nt, Human
uuuguggccuaugccuuggcuuuuccccgggc

SEQ ID NO: 547326 - RNA, 32 nt, Human
uuuguggccugggcaggaugcagagaaugaca

SEQ ID NO: 547327 - RNA, 29 nt, Human
uuuguggcugugugugugacugugagugu

SEQ ID NO: 547328 - RNA, 32 nt, Human
uuuguggcuuccucuaccugugcucagccaug

SEQ ID NO: 547329 - RNA, 32 nt, Human
uuugugggaaaugaguugagaccauggacuug

SEQ ID NO: 547330 - RNA, 32 nt, Human
uuugugggaagacauaccucccagaggggcau

SEQ ID NO: 547331 - RNA, 32 nt, Human
uuugugggaaggcaugguaugagucgagauug

SEQ ID NO: 547332 - RNA, 32 nt, Human
uuugugggagaaagaggagcuggaguuacaga

SEQ ID NO: 547333 - RNA, 32 nt, Human
uuugugggagugaaucagccgguaagagcugu

SEQ ID NO: 547334 - RNA, 32 nt, Human
uuugugggcauaagcaaacaccauaacuauga

SEQ ID NO: 547335 - RNA, 32 nt, Human
uuugugggcccagcuacaaggaggacuugcag

SEQ ID NO: 547336 - RNA, 32 nt, Human
uuugugggcugcagaguugagaguugggugag

SEQ ID NO: 547337 - RNA, 32 nt, Human
uuuguggggaagggcagcugagccaaaggggu

SEQ ID NO: 547338 - RNA, 32 nt, Human
uuuguggggccugggcuucugugguuuaaggg

SEQ ID NO: 547339 - RNA, 32 nt, Human
uuuguggggccugucuccgcugccuccuucuc

SEQ ID NO: 547340 - RNA, 32 nt, Human
uuuguggggcuucgugcccugcucuggggccc

SEQ ID NO: 547341 - RNA, 32 nt, Human
uuuguggggucaggacacagagugggagggag

SEQ ID NO: 547342 - RNA, 32 nt, Human
uuuguggggucugagguuccugucccaggguu

SEQ ID NO: 547343 - RNA, 32 nt, Human
uuuguggggugagauuggggguuggaccagag

SEQ ID NO: 547344 - RNA, 32 nt, Human
uuugugggucugcccugagcugugccugugug

SEQ ID NO: 547345 - RNA, 32 nt, Human
uuuguggguguccccacuggaguguaagcccu

SEQ ID NO: 547346 - RNA, 32 nt, Human
uuugugguauaucuuuuuccaucauguuacuu

SEQ ID NO: 547347 - RNA, 32 nt, Human
uuuguggucaccacgaagaugaggaccaacuu

SEQ ID NO: 547348 - RNA, 32 nt, Human
uuuguggucaugagagcugggguggggaagga

SEQ ID NO: 547349 - RNA, 32 nt, Human
uuuguggucucgaaaaccuggaguagacagcc

SEQ ID NO: 547350 - RNA, 32 nt, Human
uuuguggucuucccaucaggaacgcuggaaag

SEQ ID NO: 547351 - RNA, 32 nt, Human
uuuguggugcugaaccuguuuaucucugucau

SEQ ID NO: 547352 - RNA, 32 nt, Human
uuuguggugucacccgcacuguuugcuucauu

SEQ ID NO: 547353 - RNA, 32 nt, Human
uuugugguuaccaagcaggguucccccuuccc

SEQ ID NO: 547354 - RNA, 32 nt, Human
uuugugguucaguauuucccaccuacauuucu

SEQ ID NO: 547355 - RNA, 32 nt, Human
uuugugguucccaaugugucugucccacccug

SEQ ID NO: 547356 - RNA, 32 nt, Human
uuugugguuugacuucuaugguguuuuaaaaa

SEQ ID NO: 547357 - RNA, 32 nt, Human
uuuguguaacaucugugcacaccauccauucc

SEQ ID NO: 547358 - RNA, 29 nt, Human
uuuguguaacugugugugcauguuggucu

SEQ ID NO: 547359 - RNA, 32 nt, Human
uuuguguacaguuaaaggagagauggccaagc

SEQ ID NO: 547360 - RNA, 31 nt, Human
uuuguguaccuuuucugucauauucagaaac

SEQ ID NO: 547361 - RNA, 32 nt, Human
uuuguguacuaaaacuaccagcguauagauuu

SEQ ID NO: 547362 - RNA, 31 nt, Human
uuuguguaucuuuucugacugggaugggggc

SEQ ID NO: 547363 - RNA, 32 nt, Human
uuuguguauuuuuacuagagacaggguuucac

SEQ ID NO: 547364 - RNA, 32 nt, Human
uuuguguauuuuuaguagagacaggguuucac

SEQ ID NO: 547365 - RNA, 32 nt, Human
uuuguguauuuuuaguagagaugggguuucac

SEQ ID NO: 547366 - RNA, 32 nt, Human
uuugugucaccuuugaaucugaggcaguuucc

SEQ ID NO: 547367 - RNA, 32 nt, Human
uuugugucaucccaucagcaaugaaggucccu

SEQ ID NO: 547368 - RNA, 32 nt, Human
uuuguguccagaaacugcaaguugacaugaau

SEQ ID NO: 547369 - RNA, 32 nt, Human
uuugugucucaaaucagauaagagaagccugu

SEQ ID NO: 547370 - RNA, 32 nt, Human
uuugugucuccugugacuaucuccuucuucac

SEQ ID NO: 547371 - RNA, 32 nt, Human
uuugugucugcagagcucuggcacucgcuucg

SEQ ID NO: 547372 - RNA, 32 nt, Human
uuugugucuggcuucuuucacuuaguacaagu

SEQ ID NO: 547373 - RNA, 32 nt, Human
uuugugucuuucuccuccuccuccugcguccc

SEQ ID NO: 547374 - RNA, 32 nt, Human
uuugugugagauguaguuuucccaucuccugg

SEQ ID NO: 547375 - RNA, 32 nt, Human
uuugugugauuccuuaccucuggcugauaaaa

SEQ ID NO: 547376 - RNA, 32 nt, Human
uuugugugcaugaaagagaaagacugauuacc

SEQ ID NO: 547377 - RNA, 32 nt, Human
uuugugugccuuccuugguacuucugagguau

SEQ ID NO: 547378 - RNA, 32 nt, Human
uuugugugcuaccucaucuugccacugcagug

SEQ ID NO: 547379 - RNA, 32 nt, Human
uuugugugggguucuuaaaaaugugagaagcu

SEQ ID NO: 547380 - RNA, 32 nt, Human
uuuguguguaugaugaacagaugucuccuuuc

SEQ ID NO: 547381 - RNA, 32 nt, Human
uuuuuaagacagagucucacucuguugcccag

SEQ ID NO: 547382 - RNA, 24 nt, Human
uuuuuaagacagggucucauucua

SEQ ID NO: 547383 - RNA, 32 nt, Human
uuuuuaagacaguauggagaaaucaccauacu

SEQ ID NO: 547384 - RNA, 31 nt, Human
uuuuuaagacaugaauuacauuuaaaauuag

SEQ ID NO: 547385 - RNA, 32 nt, Human
uuuuuaagacuuuugaccauaguguuuuccag

SEQ ID NO: 547386 - RNA, 32 nt, Human
uuuuuaagagacaggucucccuacguagccca

SEQ ID NO: 547387 - RNA, 32 nt, Human
uuuuuaagaggugaaaucauuugcugguuguu

SEQ ID NO: 547388 - RNA, 32 nt, Human
uuuuuaagauagagucucacucugcugcccgg

SEQ ID NO: 547389 - RNA, 32 nt, Human
uuuuuaagccaugacaucccagaagaggacag

SEQ ID NO: 547390 - RNA, 32 nt, Human
uuuuuaagcugcauacuugaggcuuaccuucu

SEQ ID NO: 547391 - RNA, 21 nt, Human
uuuuuaaggacccaaguuccu

SEQ ID NO: 547392 - RNA, 32 nt, Human
uuuuuaaggcugggaaccccuccuuccaucuu

SEQ ID NO: 547393 - RNA, 32 nt, Human
uuuuuaaggggcuguggggugaaauguugacu

SEQ ID NO: 547394 - RNA, 32 nt, Human
uuuuuaaggugaggacucagaaaaucaaaggg

SEQ ID NO: 547395 - RNA, 32 nt, Human
uuuuuaaguacugcaccaaaaccaaagagcug

SEQ ID NO: 547396 - RNA, 32 nt, Human
uuuuuaaguaugacagagcagggccuuaaucc

SEQ ID NO: 547397 - RNA, 32 nt, Human
uuuuuaaguggacuaaucagagcuguuaaugc

SEQ ID NO: 547398 - RNA, 32 nt, Human
uuuuuaauaacagcuuaaaacacacaucguac

SEQ ID NO: 547399 - RNA, 32 nt, Human
uuuuuaauaagaaacauuuaccaagggagcau

SEQ ID NO: 547400 - RNA, 32 nt, Human
uuuuuaauaccacagaaaucaccugaguguca

SEQ ID NO: 547401 - RNA, 32 nt, Human
uuuuuaauacuacuuuuuaaaaggaauuuaua

SEQ ID NO: 547402 - RNA, 32 nt, Human
uuuuuaaucucccauagugccuggcucacagg

SEQ ID NO: 547403 - RNA, 32 nt, Human
uuuuuaaucuucuuccuauguuuuggaauucu

SEQ ID NO: 547404 - RNA, 32 nt, Human
uuuuuaaugaauagggaccaaugccacauugc

SEQ ID NO: 547405 - RNA, 32 nt, Human
uuuuuaaugagagaaaaucuguucuuuccagc

SEQ ID NO: 547406 - RNA, 32 nt, Human
uuuuuaauguaaucauuugcauugguuaggaa

SEQ ID NO: 547407 - RNA, 32 nt, Human
uuuuuaauguuagguauuuguagcauaaggcc

SEQ ID NO: 547408 - RNA, 32 nt, Human
uuuuuaauuaaacuuuggaacagcgaauuugg

SEQ ID NO: 547409 - RNA, 27 nt, Human
uuuuuaauuaaacuuuggaacagugaa

SEQ ID NO: 547410 - RNA, 32 nt, Human
uuuuuaauuccugcugcacuaaagcuauuaca

SEQ ID NO: 547411 - RNA, 32 nt, Human
uuuuuaauugagauggagucuugcacugucac

SEQ ID NO: 547412 - RNA, 32 nt, Human
uuuuuaauugcaagcauauuucuuugaaugac

SEQ ID NO: 547413 - RNA, 32 nt, Human
uuuuuaauugccaaacugcucucuucaucagc

SEQ ID NO: 547414 - RNA, 32 nt, Human
uuuuuaauuuucccccagcucagaaucuugcu

SEQ ID NO: 547415 - RNA, 32 nt, Human
uuuuuaauuuucugagguuuuggaaguuguag

SEQ ID NO: 547416 - RNA, 32 nt, Human
uuuuuacaacccccuuaacaccuuuuggagau

SEQ ID NO: 547417 - RNA, 32 nt, Human
uuuuuacaaguuggcaaaaacagacuuccggg

SEQ ID NO: 547418 - RNA, 32 nt, Human
uuuuuacaauaauguaaaaauuaaacuguuua

SEQ ID NO: 547419 - RNA, 32 nt, Human
uuuuuacacaaaacaagggcuuagaguauacu

SEQ ID NO: 547420 - RNA, 32 nt, Human
uuuuuacacuccuuaaaacaguuuuuaagucg

SEQ ID NO: 547421 - RNA, 32 nt, Human
uuuuuacagaccaugaaauggaggcucagggg

SEQ ID NO: 547422 - RNA, 32 nt, Human
uuuuuacagauagggaaauagcacagaaaggu

SEQ ID NO: 547423 - RNA, 32 nt, Human
uuuuuacagcacaaacaacugcauacggcccg

SEQ ID NO: 547424 - RNA, 32 nt, Human
uuuuuacagcacacacuuccauaugucauugc

SEQ ID NO: 547425 - RNA, 32 nt, Human
uuuuuacagcccacccugcucuccuccccuau

SEQ ID NO: 547426 - RNA, 32 nt, Human
uuuuuacaucucucucacccuucuacuuccua

SEQ ID NO: 547427 - RNA, 32 nt, Human
uuuuuacaugccacagcucagcugucugccug

SEQ ID NO: 547428 - RNA, 32 nt, Human
uuuuuacauguuacauguccucauguuuucug

SEQ ID NO: 547429 - RNA, 32 nt, Human
uuuuuacauuggucaguacacaggucaggagc

SEQ ID NO: 547430 - RNA, 32 nt, Human
uuuuuaccaaagugucuuuugacauuuuauuu

SEQ ID NO: 547431 - RNA, 32 nt, Human
uuuuuaccaaauucacugucucucuuaccugu

SEQ ID NO: 547432 - RNA, 32 nt, Human
uuuuuaccacccuaccuuuauuguuagugguu

SEQ ID NO: 547433 - RNA, 32 nt, Human
uuuuuaccauaccaacuucucucccaucucua

SEQ ID NO: 547434 - RNA, 22 nt, Human
uuuuuacccaggcuggagugca

SEQ ID NO: 547435 - RNA, 32 nt, Human
uuuuuacccaggcuggagugcaaugaugcgau

SEQ ID NO: 547436 - RNA, 32 nt, Human
uuuuuacccuagauguucccaccuucagugcu

SEQ ID NO: 547437 - RNA, 32 nt, Human
uuuuuacccugaggggcucagcacucauuagg

SEQ ID NO: 547438 - RNA, 32 nt, Human
uuuuuacccugccccugccuugauuagacucc

SEQ ID NO: 547439 - RNA, 32 nt, Human
uuuuuaccuaguugcuauagugucuacagucu

SEQ ID NO: 547440 - RNA, 32 nt, Human
uuuuuaccuccugucuugcccccuaaaagaaa

SEQ ID NO: 547441 - RNA, 32 nt, Human
uuuuuaccugucuuuauucaaauguucuaaua

SEQ ID NO: 547442 - RNA, 32 nt, Human
uuuuuaccuuuguuccuuuugcucugauagac

SEQ ID NO: 547443 - RNA, 32 nt, Human
uuuuuacggacugaaugauguucuccaaaauu

SEQ ID NO: 547444 - RNA, 32 nt, Human
uuuuuacucuauaauuugauaguuacaguuuu

SEQ ID NO: 547445 - RNA, 32 nt, Human
uuuuuacucuuuguugacuuugcugcuuauug

SEQ ID NO: 547446 - RNA, 32 nt, Human
uuuuuacugccucauugucuucuguacaucuu

SEQ ID NO: 547447 - RNA, 32 nt, Human
uuuuuacuguccuuaccagcaacaguuugcgu

SEQ ID NO: 547448 - RNA, 32 nt, Human
uuuuuacugucucuucugcuuacuuuccacau

SEQ ID NO: 547449 - RNA, 32 nt, Human
uuuuuacuugugaggaaugagaagccauccau

SEQ ID NO: 547450 - RNA, 32 nt, Human
uuuuuacuuuuaagucacuuuuggguucacua

SEQ ID NO: 547451 - RNA, 32 nt, Human
uuuuuagaaaacagaaaugcccuugauggugg

SEQ ID NO: 547452 - RNA, 32 nt, Human
uuuuuagaaaguauauuuuuguaugcuuuguu

SEQ ID NO: 547453 - RNA, 32 nt, Human
uuuuuagaaauccaguuuuaguuuugucauuu

SEQ ID NO: 547454 - RNA, 32 nt, Human
uuuuuagaaauguuauuuucccugugauagag

SEQ ID NO: 547455 - RNA, 32 nt, Human
uuuuuagaccaccacauggcaugcuugacuau

SEQ ID NO: 547456 - RNA, 32 nt, Human
uuuuuagaccucuaucaaucaguaguuagcau

SEQ ID NO: 547457 - RNA, 23 nt, Human
uuuuuagacggagucucacucug

SEQ ID NO: 547458 - RNA, 32 nt, Human
uuuuuagacuauuuaucuuccuucccuucccc

SEQ ID NO: 547459 - RNA, 32 nt, Human
uuuuuagagaaagggucucacuauguugccca

SEQ ID NO: 547460 - RNA, 32 nt, Human
uuuuuagagacagagcuucuccauguugccca

SEQ ID NO: 547461 - RNA, 32 nt, Human
uuuuuagagacagggauucaacauguugguua

SEQ ID NO: 547462 - RNA, 32 nt, Human
uuuuuagagacagggccuugcucuguugccug

SEQ ID NO: 547463 - RNA, 32 nt, Human
uuuuuagagacagggucucacuauaaugcuua

SEQ ID NO: 547464 - RNA, 32 nt, Human
uuuuuagagacagggucucacuauauugcuca

SEQ ID NO: 547465 - RNA, 32 nt, Human
uuuuuagagacagggucucacucuguugccca

SEQ ID NO: 547466 - RNA, 32 nt, Human
uuuuuagagacagggucuugcuauguugccca

SEQ ID NO: 547467 - RNA, 32 nt, Human
uuuuuagagacagggucuugcuauguugguca

SEQ ID NO: 547468 - RNA, 32 nt, Human
uuuuuagagacagggucuugcucugucaccca

SEQ ID NO: 547469 - RNA, 32 nt, Human
uuuuuagagacagggucuugcucugucgcuca

SEQ ID NO: 547470 - RNA, 32 nt, Human
uuuuuagagacagggucuugcucugucuccua

SEQ ID NO: 547471 - RNA, 32 nt, Human
uuuuuagagcaaauguuauggguucuuaccca

SEQ ID NO: 547472 - RNA, 32 nt, Human
uuuuuagagcaguuucauguuuacagagaaau

SEQ ID NO: 547473 - RNA, 32 nt, Human
uuuuuagagccagucaaaugguauuuaaguua

SEQ ID NO: 547474 - RNA, 32 nt, Human
uuuuuagagggaggaaucaguguuggauugca

SEQ ID NO: 547475 - RNA, 32 nt, Human
uuuuuagauaaauauguauaucaauauuuuaa

SEQ ID NO: 547476 - RNA, 32 nt, Human
uuuuuagaugaccacucaacauaaugcuuaag

SEQ ID NO: 547477 - RNA, 32 nt, Human
uuuuuagauggaaucuuguucucuugcccagg

SEQ ID NO: 547478 - RNA, 32 nt, Human
uuuuuagauggaauuucacucuuguugcccag

SEQ ID NO: 547479 - RNA, 32 nt, Human
uuuuuagcaaaauguaaugaaauaucagguug

SEQ ID NO: 547480 - RNA, 25 nt, Human
uuuuuagcaauggagucucacucug

SEQ ID NO: 547481 - RNA, 32 nt, Human
uuuuuagcacucaucaguauucuccaauguga

SEQ ID NO: 547482 - RNA, 32 nt, Human
uuuuuagcauuacguaucuguguguuacugcu

SEQ ID NO: 547483 - RNA, 32 nt, Human
uuuuuagcauucagucauauaacaucugguua

SEQ ID NO: 547484 - RNA, 32 nt, Human
uuuuuagcauugccuuuccagucuugaugauu

SEQ ID NO: 547485 - RNA, 32 nt, Human
uuuuuagccagcggggccacugacggcuucug

SEQ ID NO: 547486 - RNA, 32 nt, Human
uuuuuagccuucuuuuucugcacugagucuca

SEQ ID NO: 547487 - RNA, 32 nt, Human
uuuuuagcuagcaacauauuugaaucaggcug

SEQ ID NO: 547488 - RNA, 32 nt, Human
uuuuuagcuuugacaaacacacaaaaguggua

SEQ ID NO: 547489 - RNA, 32 nt, Human
uuuuuaggaaggauuuucuuuuuaacuuuacc

SEQ ID NO: 547490 - RNA, 32 nt, Human
uuuuuaggagauggucuugcucugucacucag

SEQ ID NO: 547491 - RNA, 32 nt, Human
uuuuuaggccagcuuuaauuuaauggcccuac

SEQ ID NO: 547492 - RNA, 32 nt, Human
uuuuuaggccucuucucagcacacuguuccaa

SEQ ID NO: 547493 - RNA, 32 nt, Human
uuuuuaggcugaaguagagaacaugaaucauu

SEQ ID NO: 547494 - RNA, 21 nt, Human
uuuuuaggcugggcgcagugg

SEQ ID NO: 547495 - RNA, 19 nt, Human
uuuuuagggaggaaugccu

SEQ ID NO: 547496 - RNA, 32 nt, Human
uuuuuagggugagguguagggggucuuuugcu

SEQ ID NO: 547497 - RNA, 32 nt, Human
uuuuuagguuuuucuuucacauagacgggguc

SEQ ID NO: 547498 - RNA, 32 nt, Human
uuuuuaguacuugcugaagaaugauucagggu

SEQ ID NO: 547499 - RNA, 32 nt, Human
uuuuuaguagugggauuuccaucuacaaaaua

SEQ ID NO: 547500 - RNA, 32 nt, Human
uuuuuaguauaucuugucgaucuuuaaguugu

SEQ ID NO: 547501 - RNA, 31 nt, Human
uuuuuagugcaucguccaugccaaagugugc

SEQ ID NO: 547502 - RNA, 32 nt, Human
uuuuuauaaagagagauucuuauuuucuuggc

SEQ ID NO: 547503 - RNA, 32 nt, Human
uuuuuauaaguuauacauguaugcauguauac

SEQ ID NO: 547504 - RNA, 32 nt, Human
uuuuuauaaugucuuuuuggagaaauugccga

SEQ ID NO: 547505 - RNA, 32 nt, Human
uuuuuauacaauuguguauuuauagggauacc

SEQ ID NO: 547506 - RNA, 32 nt, Human
uuuuuauacaccauuguuccuuaccuuuacau

SEQ ID NO: 547507 - RNA, 32 nt, Human
uuuuuauacagcaacagaaaacuaaacacaca

SEQ ID NO: 547508 - RNA, 32 nt, Human
uuuuuauaccaguuuuggagacugccugagau

SEQ ID NO: 547509 - RNA, 32 nt, Human
uuuuuauauucuuuaguaaagacaggguuucu

SEQ ID NO: 547510 - RNA, 32 nt, Human
uuuuuauauuuuuaauagagacgggguuucac

SEQ ID NO: 547511 - RNA, 32 nt, Human
uuuuuauauuuuuaguagagacaggguuucac

SEQ ID NO: 547512 - RNA, 32 nt, Human
uuuuuauauuuuuaguagagauggggacuuca

SEQ ID NO: 547513 - RNA, 32 nt, Human
uuuuuauauuuuuaguagagaugggguuucac

SEQ ID NO: 547514 - RNA, 32 nt, Human
uuuuuauauuuuuaguagagaugggguuuugc

SEQ ID NO: 547515 - RNA, 32 nt, Human
uuuuuauauuuuuaguggagaugggguuuugu

SEQ ID NO: 547516 - RNA, 31 nt, Human
uuuuuaucaauaaauacuuguugauuguggu

SEQ ID NO: 547517 - RNA, 32 nt, Human
uuuuuaucacacuuauaggccaagugugauaa

SEQ ID NO: 547518 - RNA, 32 nt, Human
uuuuuaucaccagcaaaggcuaagauaaugua

SEQ ID NO: 547519 - RNA, 32 nt, Human
uuuuuaucauggaccagaacaucugucaugca

SEQ ID NO: 547520 - RNA, 32 nt, Human
uuuuuauccauagcuuuuuccauauaaguaug

SEQ ID NO: 547521 - RNA, 32 nt, Human
uuuuuauccuuggcacuauaccaaaauccaac

SEQ ID NO: 547522 - RNA, 32 nt, Human
uuuuuaucuccaaagauuuacaaauauuaaaa

SEQ ID NO: 547523 - RNA, 22 nt, Human
uuuuuaucucucucaacuuccu

SEQ ID NO: 547524 - RNA, 32 nt, Human
uuuuuaucucucucaacuuccugcacuuaaca

SEQ ID NO: 547525 - RNA, 32 nt, Human
uuuuuaucucugaagggcaguagccugaagau

SEQ ID NO: 547526 - RNA, 32 nt, Human
uuuuuaugagcacacuaauuccucacuuaagg

SEQ ID NO: 547527 - RNA, 32 nt, Human
uuuuuaugccucucccuggcauucuccauaaa

SEQ ID NO: 547528 - RNA, 32 nt, Human
uuuuuaugcuucugguauugcuuuauaaaaga

SEQ ID NO: 547529 - RNA, 32 nt, Human
uuuuuauggaguuucauguuguccacuauagc

SEQ ID NO: 547530 - RNA, 32 nt, Human
uuuuuauggauggcucccuucccccauucgcc

SEQ ID NO: 547531 - RNA, 32 nt, Human
uuuuuauguaaaauagcguagaugcaucucug

SEQ ID NO: 547532 - RNA, 32 nt, Human
uuuuuaugugaagcccccucugcuuuucagcu

SEQ ID NO: 547533 - RNA, 32 nt, Human
uuuuuauguucuuugacccacaccaucaacac

SEQ ID NO: 547534 - RNA, 32 nt, Human
uuuuuauuaagaaaucagaucccagggugaga

SEQ ID NO: 547535 - RNA, 32 nt, Human
uuuuuauuacuuuugcgugaauuuauuuaaca

SEQ ID NO: 547536 - RNA, 32 nt, Human
uuuuuauuagagacaagggcuccccauguugc

SEQ ID NO: 547537 - RNA, 32 nt, Human
uuuuuauuagggauuuuaaaaggggaggggug

SEQ ID NO: 547538 - RNA, 32 nt, Human
uuuuuauucacuguagugugguggacgguggu

SEQ ID NO: 547539 - RNA, 32 nt, Human
uuuuuauuccuuaaauguaaaaugacuaccua

SEQ ID NO: 547540 - RNA, 32 nt, Human
uuuuuauucucagagcaucagcacuugaggcc

SEQ ID NO: 547541 - RNA, 32 nt, Human
uuuuuauucuuuagucccuguugucuuuaauu

SEQ ID NO: 547542 - RNA, 32 nt, Human
uuuuuauugcagaauaauguuccaggguaugg

SEQ ID NO: 547543 - RNA, 32 nt, Human
uuuuuauugcuauuucuaaauuuccuuggcuu

SEQ ID NO: 547544 - RNA, 32 nt, Human
uuuuuauuuaguguuuucucagucacaauuuu

SEQ ID NO: 547545 - RNA, 32 nt, Human
uuuuuauuucuagaagacauuuuacuaggcaa

SEQ ID NO: 547546 - RNA, 32 nt, Human
uuuuuauuucuuucuuuuccauggaggccuag

SEQ ID NO: 547547 - RNA, 32 nt, Human
uuuuuauuugaaccuuuggaacuugggaguuc

SEQ ID NO: 547548 - RNA, 23 nt, Human
uuuuuauuuguuucaauguuccu

SEQ ID NO: 547549 - RNA, 32 nt, Human
uuuuuauuuucagcacugcagcucugaugguc

SEQ ID NO: 547550 - RNA, 32 nt, Human
uuuuuauuuuugcacaacuuuugagaguauag

SEQ ID NO: 547551 - RNA, 32 nt, Human
uuuuucaaaacaauguugaagagugaugacag

SEQ ID NO: 547552 - RNA, 32 nt, Human
uuuuucaaaagaugcucucugcagcaguaaga

SEQ ID NO: 547553 - RNA, 32 nt, Human
uuuuucaaaccacagaccagaacugguugcau

SEQ ID NO: 547554 - RNA, 32 nt, Human
uuuuucaaagcuggguguugggaccaacauca

SEQ ID NO: 547555 - RNA, 32 nt, Human
uuuuucaacauguagggcaagaggaugaagga

SEQ ID NO: 547556 - RNA, 32 nt, Human
uuuuucaacuaguguuucaacagguuuauuua

SEQ ID NO: 547557 - RNA, 32 nt, Human
uuuuucaagacagggucucaacucuguuaccc

SEQ ID NO: 547558 - RNA, 32 nt, Human
uuuuucaagauccaaggcacaauaggcauaaa

SEQ ID NO: 547559 - RNA, 24 nt, Human
uuuuucaagcucuaccaugcuuug

SEQ ID NO: 547560 - RNA, 32 nt, Human
uuuuucaauguauacuuucacuuuccaaaugc

SEQ ID NO: 547561 - RNA, 32 nt, Human
uuuuucaauuuuuccuuguucuugucaaaggc

SEQ ID NO: 547562 - RNA, 32 nt, Human
uuuuucacaagaacugggucuccagcacucac

SEQ ID NO: 547563 - RNA, 32 nt, Human
uuuuucacaaugauuaaugaacaaaaacaaag

SEQ ID NO: 547564 - RNA, 32 nt, Human
uuuuucacacucgcagcucucccuccucaggc

SEQ ID NO: 547565 - RNA, 32 nt, Human
uuuuucacagccgagaaacagugcagcaguau

SEQ ID NO: 547566 - RNA, 32 nt, Human
uuuuucacagcucuugaguauuuucuauuuuu

SEQ ID NO: 547567 - RNA, 32 nt, Human
uuuuucacaguggccucacuacgcccaucucc

SEQ ID NO: 547568 - RNA, 32 nt, Human
uuuuucaccaaacugucucugccucuuccugg

SEQ ID NO: 547569 - RNA, 32 nt, Human
uuuuucaccaaacugucucugccucuucucag

SEQ ID NO: 547570 - RNA, 32 nt, Human
uuuuucaccaauauuucucagacaucgguuca

SEQ ID NO: 547571 - RNA, 32 nt, Human
uuuuucaccagaggauccagauuucccugugg

SEQ ID NO: 547572 - RNA, 32 nt, Human
uuuuucacccuuuggaaucauaguauggguag

SEQ ID NO: 547573 - RNA, 32 nt, Human
uuuuucacuccaccaaaucuuacaaaucauug

SEQ ID NO: 547574 - RNA, 32 nt, Human
uuuuucacucugcagugugauuggacugccag

SEQ ID NO: 547575 - RNA, 32 nt, Human
uuuuucacugcucugugccuguccguauaagc

SEQ ID NO: 547576 - RNA, 32 nt, Human
uuuuucacuguaucaaacaaugucagugcuuu

SEQ ID NO: 547577 - RNA, 32 nt, Human
uuuuucacugucuuuuucuuuucgcggggaac

SEQ ID NO: 547578 - RNA, 32 nt, Human
uuuuucacuucuccccacaucucccuuuccac

SEQ ID NO: 547579 - RNA, 32 nt, Human
uuuuucagaaaauauuuaauuucuucauaaaa

SEQ ID NO: 547580 - RNA, 32 nt, Human
uuuuucagaacucauagauaaauaugaaugua

SEQ ID NO: 547581 - RNA, 32 nt, Human
uuuuucagacagagucucgcucuguugcccag

SEQ ID NO: 547582 - RNA, 32 nt, Human
uuuuucagacugauccuuucucugccuguauu

SEQ ID NO: 547583 - RNA, 32 nt, Human
uuuuucagauaaggagaauuagacucccaagu

SEQ ID NO: 547584 - RNA, 32 nt, Human
uuuuucagaucaaaaccauucuguaaaaucuu

SEQ ID NO: 547585 - RNA, 32 nt, Human
uuuuucagauggaguuuuguucuuguugccca

SEQ ID NO: 547586 - RNA, 32 nt, Human
uuuuucagauggccacggugagggcuuggaag

SEQ ID NO: 547587 - RNA, 32 nt, Human
uuuuucagauugacuagaccaagcagaaucuc

SEQ ID NO: 547588 - RNA, 32 nt, Human
uuuuucagauugacuaggccaagcagaaucuc

SEQ ID NO: 547589 - RNA, 32 nt, Human
uuuuucagauuucucuggaauccccuuggcca

SEQ ID NO: 547590 - RNA, 32 nt, Human
uuuuucagcaaaugccugguucugaaggguca

SEQ ID NO: 547591 - RNA, 32 nt, Human
uuuuucagccccggagaggguccugaccuggg

SEQ ID NO: 547592 - RNA, 32 nt, Human
uuuuucagcuccauuguaaucuuacgggauca

SEQ ID NO: 547593 - RNA, 32 nt, Human
uuuuucagcuugcaaaaugggacugcaauauu

SEQ ID NO: 547594 - RNA, 32 nt, Human
uuuuucaggaaggcgaccggcagccucgggca

SEQ ID NO: 547595 - RNA, 32 nt, Human
uuuuucagggucuuauucugucacccaggcug

SEQ ID NO: 547596 - RNA, 32 nt, Human
uuuuucaguagagaccgggucuugccaugcug

SEQ ID NO: 547597 - RNA, 32 nt, Human
uuuuucaguccagguuggagaucguagcugcu

SEQ ID NO: 547598 - RNA, 32 nt, Human
uuuuucauaaaugaucuauaucaggcugaaua

SEQ ID NO: 547599 - RNA, 32 nt, Human
uuuuucaucacugagcauuguugaucuaugcc

SEQ ID NO: 547600 - RNA, 32 nt, Human
uuuuucauccacugcaggaauguggccacagg

SEQ ID NO: 547601 - RNA, 32 nt, Human
uuuuucauccuuacaauccugucccaugguau

SEQ ID NO: 547602 - RNA, 32 nt, Human
uuuuucaucugggaugaaaaagccugguucuc

SEQ ID NO: 547603 - RNA, 32 nt, Human
uuuuucaucuguacccuacucacacacucccc

SEQ ID NO: 547604 - RNA, 32 nt, Human
uuuuucaucugugucuucucaacacccagcac

SEQ ID NO: 547605 - RNA, 32 nt, Human
uuuuucauuuacccuauaugaagaaaacuaaa

SEQ ID NO: 547606 - RNA, 32 nt, Human
uuuuucauuuuugguagagacaggguuuugcc

SEQ ID NO: 547607 - RNA, 32 nt, Human
uuuuuccaaacaguagguuucauccaagacca

SEQ ID NO: 547608 - RNA, 32 nt, Human
uuuuuccaacuuauacuaaagagcuagcauau

SEQ ID NO: 547609 - RNA, 32 nt, Human
uuuuuccacagacuugcugggacuagcuuuca

SEQ ID NO: 547610 - RNA, 32 nt, Human
uuuuuccacaucuguagugccaugaagcgauu

SEQ ID NO: 547611 - RNA, 32 nt, Human
uuuuuccacaugcaugaaaauauguauuaauc

SEQ ID NO: 547612 - RNA, 32 nt, Human
uuuuuccacuuuaucgugcagcaagaguaaag

SEQ ID NO: 547613 - RNA, 32 nt, Human
uuuuuccacuuuggaaaaugucacugugacaa

SEQ ID NO: 547614 - RNA, 32 nt, Human
uuuuuccagauucuuccacuggcuccacaucc

SEQ ID NO: 547615 - RNA, 32 nt, Human
uuuuuccagccaagcagcagcuuuauuagugg

SEQ ID NO: 547616 - RNA, 32 nt, Human
uuuuuccaggcugucugugaagccuggggaac

SEQ ID NO: 547617 - RNA, 32 nt, Human
uuuuuccagggaggggugggagagggaauuua

SEQ ID NO: 547618 - RNA, 32 nt, Human
uuuuuccagguuccugagcccuacugugucuc

SEQ ID NO: 547619 - RNA, 32 nt, Human
uuuuuccagugaaacaaaacguaagaaucuga

SEQ ID NO: 547620 - RNA, 32 nt, Human
uuuuuccagugcccagaggccugguggagcca

SEQ ID NO: 547621 - RNA, 32 nt, Human
uuuuuccauauguauauaguaaaauauguuac

SEQ ID NO: 547622 - RNA, 32 nt, Human
uuuuuccauccagcaacauccagacgauuuca

SEQ ID NO: 547623 - RNA, 32 nt, Human
uuuuuccaucucccuucucccuugucaucaga

SEQ ID NO: 547624 - RNA, 32 nt, Human
uuuuuccaucuuaugaauucagaagaagcuug

SEQ ID NO: 547625 - RNA, 32 nt, Human
uuuuuccaucuugggcaggaauggguggcaua

SEQ ID NO: 547626 - RNA, 32 nt, Human
uuuuuccauuuaggaggguauucugggccuuc

SEQ ID NO: 547627 - RNA, 32 nt, Human
uuuuucccaagucccuaggugcugccagugcu

SEQ ID NO: 547628 - RNA, 32 nt, Human
uuuuucccagaacacuucacauggagcagcga

SEQ ID NO: 547629 - RNA, 20 nt, Human
uuuuucccagccaccccucc

SEQ ID NO: 547630 - RNA, 32 nt, Human
uuuuucccaguaaaugaggcaagcaauucuaa

SEQ ID NO: 547631 - RNA, 32 nt, Human
uuuuucccaguaaaugaggcaggcaauucuaa

SEQ ID NO: 547632 - RNA, 32 nt, Human
uuuuucccaucccuucuucuugcucagagagg

SEQ ID NO: 547633 - RNA, 32 nt, Human
uuuuuccccaacagaccugucuucacccuugg

SEQ ID NO: 547634 - RNA, 32 nt, Human
uuuuuccccacaaauaaauuaucagguuaaac

SEQ ID NO: 547635 - RNA, 32 nt, Human
uuuuuccccaggagcggggccugggagcugag

SEQ ID NO: 547636 - RNA, 32 nt, Human
uuuuucccccuccccgggggccaagggcuccg

SEQ ID NO: 547637 - RNA, 32 nt, Human
uuuuucccccuccuccccuccuuucuguccuc

SEQ ID NO: 547638 - RNA, 32 nt, Human
uuuuuccccuacuguuuccuuugggaauuuac

SEQ ID NO: 547639 - RNA, 32 nt, Human
uuuuuccccugccaaucucucuagcacugguu

SEQ ID NO: 547640 - RNA, 32 nt, Human
uuuuuccccuuagaugccuggaagugguauuu

SEQ ID NO: 547641 - RNA, 32 nt, Human
uuuuuccccuucucuuaaaaccacagaggacc

SEQ ID NO: 547642 - RNA, 32 nt, Human
uuuuucccucccccaccuuucaccccacagug

SEQ ID NO: 547643 - RNA, 32 nt, Human
uuuuucccuggaagugacuuuccucuuuugca

SEQ ID NO: 547644 - RNA, 32 nt, Human
uuuuuccgcagcugcaucuuucugccuggacu

SEQ ID NO: 547645 - RNA, 32 nt, Human
uuuuuccuaaccuuuugcuauuauaaauaaug

SEQ ID NO: 547646 - RNA, 32 nt, Human
uuuuuccuaccauuucuauuucauacauucuc

SEQ ID NO: 547647 - RNA, 16 nt, Human
uuuuuccuaugcagug

SEQ ID NO: 547648 - RNA, 32 nt, Human
uuuuuccuaugcauacauaccugugauuaagu

SEQ ID NO: 547649 - RNA, 32 nt, Human
uuuuuccuccccuccuccuccucuccaauucg

SEQ ID NO: 547650 - RNA, 32 nt, Human
uuuuuccucccugccccucucucccucugccc

SEQ ID NO: 547651 - RNA, 32 nt, Human
uuuuuccucuacugacuucucuccauacucuu

SEQ ID NO: 547652 - RNA, 32 nt, Human
uuuuuccucuaggagaauacaagccuuaauaa

SEQ ID NO: 547653 - RNA, 32 nt, Human
uuuuuccugcaacccaccagaccccaggccuc

SEQ ID NO: 547654 - RNA, 32 nt, Human
uuuuuccugcagcgcgugcgugcugcgcuacu

SEQ ID NO: 547655 - RNA, 32 nt, Human
uuuuuccugcauucuguggauccuagcagaua

SEQ ID NO: 547656 - RNA, 32 nt, Human
uuuuuccugccugagucuugcauaucugugaa

SEQ ID NO: 547657 - RNA, 32 nt, Human
uuuuuccuggcacaucacucaacuacuauuag

SEQ ID NO: 547658 - RNA, 32 nt, Human
uuuuuccugggaacgcgcugaauggaguccag

SEQ ID NO: 547659 - RNA, 32 nt, Human
uuuuuccuguggauauuucuccauccuaaaaa

SEQ ID NO: 547660 - RNA, 32 nt, Human
uuuuuccuguguauuaaaccuuuccauuuuac

SEQ ID NO: 547661 - RNA, 32 nt, Human
uuuuuccuuaucuuguuuuccacaauucacaa

SEQ ID NO: 547662 - RNA, 32 nt, Human
uuuuuccuucaagaaugcaguacuaacauuua

SEQ ID NO: 547663 - RNA, 32 nt, Human
uuuuuccuucaagguucauccauguuguucca

SEQ ID NO: 547664 - RNA, 32 nt, Human
uuuuuccuucucuucucucucuuuuccuaggu

SEQ ID NO: 547665 - RNA, 32 nt, Human
uuuuuccuucuucaggguggcuguaauuccag

SEQ ID NO: 547666 - RNA, 32 nt, Human
uuuuuccuucuuuccuuucuucuuucucuuuc

SEQ ID NO: 547667 - RNA, 32 nt, Human
uuuuuccuugcagccgcugaggaggcgauaaa

SEQ ID NO: 547668 - RNA, 32 nt, Human
uuuuuccuuguuuuucucuuuuuaaagaccaa

SEQ ID NO: 547669 - RNA, 32 nt, Human
uuuuuccuuuaccucauaugcagcugugguag

SEQ ID NO: 547670 - RNA, 32 nt, Human
uuuuuccuuuacucaaaacaaaacaauuuuua

SEQ ID NO: 547671 - RNA, 32 nt, Human
uuuuuccuuuucucccuccgggucuccuuuuu

SEQ ID NO: 547672 - RNA, 32 nt, Human
uuuuuccuuuuguguucugucaccaacugaag

SEQ ID NO: 547673 - RNA, 32 nt, Human
uuuuucgaacaaggugucuggucuuuucugga

SEQ ID NO: 547674 - RNA, 32 nt, Human
uuuuucgagacaggaucucacucuguugccca

SEQ ID NO: 547675 - RNA, 32 nt, Human
uuuuucgagacagggucuugcucugucaccua

SEQ ID NO: 547676 - RNA, 32 nt, Human
uuuuucgcaguggccuccugcauuucaugaag

SEQ ID NO: 547677 - RNA, 32 nt, Human
uuuuucgcaucauuaucuugugccucauucau

SEQ ID NO: 547678 - RNA, 32 nt, Human
uuuuucgccauguugcccaggcuggucuugaa

SEQ ID NO: 547679 - RNA, 32 nt, Human
uuuuucggaaagugcuuuuggccgggagugcc

SEQ ID NO: 547680 - RNA, 32 nt, Human
uuuuucggaggagccgagggaggcugagcggu

SEQ ID NO: 547681 - RNA, 32 nt, Human
uuuuucguauuuuuaguaaagacaggguuuca

SEQ ID NO: 547682 - RNA, 32 nt, Human
uuuuucguguuuuugacauuccuugaaucugu

SEQ ID NO: 547683 - RNA, 32 nt, Human
uuuuucuaaaauccaacuucugaccgcccagu

SEQ ID NO: 547684 - RNA, 24 nt, Human
uuuuucuaaauacaguguuuuuca

SEQ ID NO: 547685 - RNA, 32 nt, Human
uuuuucuaaccucagauaagugcagugucuuu

SEQ ID NO: 547686 - RNA, 32 nt, Human
uuuuucuaaggguuucgugucccucuuuuauc

SEQ ID NO: 547687 - RNA, 32 nt, Human
uuuuucuaauggcuucucuauaucuuuuacau

SEQ ID NO: 547688 - RNA, 32 nt, Human
uuuuucuacauacuuuuuacacagauucuaug

SEQ ID NO: 547689 - RNA, 32 nt, Human
uuuuucuacauccugaacuauuuuuccuauuu

SEQ ID NO: 547690 - RNA, 32 nt, Human
uuuuucuacuucucaauuugaugguucgauua

SEQ ID NO: 547691 - RNA, 21 nt, Human
uuuuucuagaugguuuuuuca

SEQ ID NO: 547692 - RNA, 32 nt, Human
uuuuucuagcuacaauaucuucauacaaugac

SEQ ID NO: 547693 - RNA, 32 nt, Human
uuuuucuagcuagacuguaaacuccuuaagga

SEQ ID NO: 547694 - RNA, 32 nt, Human
uuuuucuagcuuccauccuuucucccucguuu

SEQ ID NO: 547695 - RNA, 32 nt, Human
uuuuucuauagcccuggcacugggcacagagc

SEQ ID NO: 547696 - RNA, 32 nt, Human
uuuuucuaucaauuuucccccaucccaucccc

SEQ ID NO: 547697 - RNA, 32 nt, Human
uuuuucuauguacuggauauuuuugcauauaa

SEQ ID NO: 547698 - RNA, 32 nt, Human
uuuuucuauuaagaauacaaaugcugggcugg

SEQ ID NO: 547699 - RNA, 32 nt, Human
uuuuucuauuaagccauugaaagagaagcacu

SEQ ID NO: 547700 - RNA, 32 nt, Human
uuuuucuauuuuuaguagagacaggguuucac

SEQ ID NO: 547701 - RNA, 32 nt, Human
uuuuucuauuuuuaguagagaugggguuucgc

SEQ ID NO: 547702 - RNA, 32 nt, Human
uuuuucuauuuuuauuauuuuagagaugggga

SEQ ID NO: 547703 - RNA, 32 nt, Human
uuuuucucaaucucccagccccucucuaccau

SEQ ID NO: 547704 - RNA, 32 nt, Human
uuuuucucacguuucacaucucacucaucacc

SEQ ID NO: 547705 - RNA, 32 nt, Human
uuuuucucagcccacguguucucccccacgug

SEQ ID NO: 547706 - RNA, 32 nt, Human
uuuuucucaguuaccugcaugaauaaauaaug

SEQ ID NO: 547707 - RNA, 32 nt, Human
uuuuucucauccaucacacuccugccuuaacu

SEQ ID NO: 547708 - RNA, 32 nt, Human
uuuuucucauucuccauaccucccccaagcuc

SEQ ID NO: 547709 - RNA, 32 nt, Human
uuuuucucauuugucuguggcauuggagaaua

SEQ ID NO: 547710 - RNA, 32 nt, Human
uuuuucuccaauuuggcugggauuauucaaag

SEQ ID NO: 547711 - RNA, 32 nt, Human
uuuuucucccccaagugagcugcaagaggccc

SEQ ID NO: 547712 - RNA, 32 nt, Human
uuuuucucccccuucaccaggguggguggaau

SEQ ID NO: 547713 - RNA, 32 nt, Human
uuuuucuccccuuccuccuuacccucccuccc

SEQ ID NO: 547714 - RNA, 32 nt, Human
uuuuucucccucuccaccaggguggguggaau

SEQ ID NO: 547715 - RNA, 19 nt, Human
uuuuucuccgcuugcugug

SEQ ID NO: 547716 - RNA, 32 nt, Human
uuuuucuccugacuugaacauagggugacuuu

SEQ ID NO: 547717 - RNA, 32 nt, Human
uuuuucuccugccuucuccuggagaugaagag

SEQ ID NO: 547718 - RNA, 32 nt, Human
uuuuucuccuuuccuuucauuccaaaaagccu

SEQ ID NO: 547719 - RNA, 32 nt, Human
uuuuucucuaaguucuuaacauguuauguccc

SEQ ID NO: 547720 - RNA, 32 nt, Human
uuuuucucuaauuggucgccucccaccagacu

SEQ ID NO: 547721 - RNA, 32 nt, Human
uuuuucucucauccuucuaccucccuccuuug

SEQ ID NO: 547722 - RNA, 32 nt, Human
uuuuucucucauuuucuucccucucucccucc

SEQ ID NO: 547723 - RNA, 32 nt, Human
uuuuucucugcagauaguugcuucucuugcuu

SEQ ID NO: 547724 - RNA, 32 nt, Human
uuuuucucugugagccgcugccuccagggcca

SEQ ID NO: 547725 - RNA, 32 nt, Human
uuuuucucuguggcuguauguggguugcuugg

SEQ ID NO: 547726 - RNA, 32 nt, Human
uuuuucucuucuccucuuccuggcuguguuuu

SEQ ID NO: 547727 - RNA, 32 nt, Human
uuuuucucuuguaaacaaaccccagcuuguuu

SEQ ID NO: 547728 - RNA, 32 nt, Human
uuuuucucuuucuccuccuggccuggccugaa

SEQ ID NO: 547729 - RNA, 32 nt, Human
uuuuucucuuucuguccuuuuucuugcugauu

SEQ ID NO: 547730 - RNA, 24 nt, Human
uuuuucugaagacagucuuuuuca

SEQ ID NO: 547731 - RNA, 32 nt, Human
uuuuucugacuuuuuaaaucauuaucauuauu

SEQ ID NO: 547732 - RNA, 32 nt, Human
uuuuucugaguauaauguuauuacaugguccu

SEQ ID NO: 547733 - RNA, 32 nt, Human
uuuuucugccagugucuugucugaaggcagac

SEQ ID NO: 547734 - RNA, 32 nt, Human
uuuuucugcccaguggcucugaugggggcuca

SEQ ID NO: 547735 - RNA, 32 nt, Human
uuuuucugcccucccuauuuuaacuagaugau

SEQ ID NO: 547736 - RNA, 32 nt, Human
uuuuucugccuccacauugggaggggaggacu

SEQ ID NO: 547737 - RNA, 32 nt, Human
uuuuucugcgggaguagguggggagaaacuua

SEQ ID NO: 547738 - RNA, 32 nt, Human
uuuuucugcuaagcacaaaaugaacgcaaagc

SEQ ID NO: 547739 - RNA, 32 nt, Human
uuuuucugcuguucuuggcccaaguucuuucc

SEQ ID NO: 547740 - RNA, 32 nt, Human
uuuuucugcuuucauuuuaauuuugggaaauu

SEQ ID NO: 547741 - RNA, 32 nt, Human
uuuuucugcuuucugucuuucucccucuccuu

SEQ ID NO: 547742 - RNA, 21 nt, Human
uuuuucugcuuuguuuuuuca

SEQ ID NO: 547743 - RNA, 32 nt, Human
uuuuucuggaaacacauuuauggcuuuuauaa

SEQ ID NO: 547744 - RNA, 32 nt, Human
uuuuucugggcuuuuccuuuugcacauuccaa

SEQ ID NO: 547745 - RNA, 32 nt, Human
uuuuucugguccauuucccauuuccuuuucuu

SEQ ID NO: 547746 - RNA, 32 nt, Human
uuuuucuguaguucacuguauaaaguauuugg

SEQ ID NO: 547747 - RNA, 32 nt, Human
uuuuucugucaauauguccuugcccacugccu

SEQ ID NO: 547748 - RNA, 32 nt, Human
uuuuucugucaugcccugggggcuucugcucu

SEQ ID NO: 547749 - RNA, 32 nt, Human
uuuuucugucuccugcugucucugugugggau

SEQ ID NO: 547750 - RNA, 32 nt, Human
uuuuucugucucuguguuugaaguuucaguuu

SEQ ID NO: 547751 - RNA, 32 nt, Human
uuuuucugucuuauguccaaccccucauuaaa

SEQ ID NO: 547752 - RNA, 32 nt, Human
uuuuucuguggcuuuagcaguggggccgugcg

SEQ ID NO: 547753 - RNA, 32 nt, Human
uuuuucugugggagagaaagaauccuagaggc

SEQ ID NO: 547754 - RNA, 32 nt, Human
uuuuucuguguaugggccuggucaguguaaag

SEQ ID NO: 547755 - RNA, 32 nt, Human
uuuuucuguugucauuaaagcaucaccaagca

SEQ ID NO: 547756 - RNA, 32 nt, Human
uuuuucuguuuuaaaauaucuuccugcacugg

SEQ ID NO: 547757 - RNA, 32 nt, Human
uuuuucuuaccagucuccuccccuacucugcc

SEQ ID NO: 547758 - RNA, 32 nt, Human
uuuuucuuagaacuucagcugauugcagagau

SEQ ID NO: 547759 - RNA, 32 nt, Human
uuuuucuucaaggagcacuagcugcuggggaa

SEQ ID NO: 547760 - RNA, 32 nt, Human
uuuuucuuccacugccacucucuuuaccuuua

SEQ ID NO: 547761 - RNA, 32 nt, Human
uuuuucuucccuucaugaacuuuagguacaca

SEQ ID NO: 547762 - RNA, 32 nt, Human
uuuuucuucccuuuuauucaccacuugacuuc

SEQ ID NO: 547763 - RNA, 32 nt, Human
uuuuucuuccuccucaacugagaucuuuccaa

SEQ ID NO: 547764 - RNA, 32 nt, Human
uuuuucuuccucuaguggguccauaacaaaua

SEQ ID NO: 547765 - RNA, 32 nt, Human
uuuuucuucuccccaccucccugcucucuuuc

SEQ ID NO: 547766 - RNA, 32 nt, Human
uuuuucuucucccccgcucccugcucucuuuc

SEQ ID NO: 547767 - RNA, 32 nt, Human
uuuuucuucugcccaggcaccauauuuuuaua

SEQ ID NO: 547768 - RNA, 32 nt, Human
uuuuucuucugcuaugugacuugcaucgugga

SEQ ID NO: 547769 - RNA, 32 nt, Human
uuuuucuucuucuuccuucugucccuccugcc

SEQ ID NO: 547770 - RNA, 32 nt, Human
uuuuucuucuucuucuucuuuugugguuucac

SEQ ID NO: 547771 - RNA, 32 nt, Human
uuuuucuucuucuugcuggugauggucuugcu

SEQ ID NO: 547772 - RNA, 32 nt, Human
uuuuucuucuuucuuucuuuugcaggaguuug

SEQ ID NO: 547773 - RNA, 32 nt, Human
uuuuucuugaaugaaauagcaggaagcuccuc

SEQ ID NO: 547774 - RNA, 32 nt, Human
uuuuucuugaugguuucccucucccucccucu

SEQ ID NO: 547775 - RNA, 32 nt, Human
uuuuucuugaugucuguggcucagucaguaua

SEQ ID NO: 547776 - RNA, 32 nt, Human
uuuuucuuggacuacuuuaauuuggauccuuu

SEQ ID NO: 547777 - RNA, 32 nt, Human
uuuuucuuggcauuacagauuuugccaaaaua

SEQ ID NO: 547778 - RNA, 32 nt, Human
uuuuucuuggguauggagguuucuugaagacc

SEQ ID NO: 547779 - RNA, 32 nt, Human
uuuuucuugguggaaauggacaaguuuaggca

SEQ ID NO: 547780 - RNA, 32 nt, Human
uuuuucuuguggugaggacacuugucuuaguc

SEQ ID NO: 547781 - RNA, 32 nt, Human
uuuuucuuguguuugcuuugcuuuuugacaac

SEQ ID NO: 547782 - RNA, 32 nt, Human
uuuuucuuuacaaaacaaacucaucauuaguc

SEQ ID NO: 547783 - RNA, 32 nt, Human
uuuuucuuuaucugaguaugggagaaaauacu

SEQ ID NO: 547784 - RNA, 32 nt, Human
uuuuucuuucauguggaaguuggaagacaagg

SEQ ID NO: 547785 - RNA, 32 nt, Human
uuuuucuuucauuuuucucucauuccauuucu

SEQ ID NO: 547786 - RNA, 32 nt, Human
uuuuucuuuccucccuuaccccaaauucauug

SEQ ID NO: 547787 - RNA, 32 nt, Human
uuuuucuuucuuccuuuccugaauacacuccc

SEQ ID NO: 547788 - RNA, 32 nt, Human
uuuuucuuucuuccuuucuuccuuggccaaga

SEQ ID NO: 547789 - RNA, 32 nt, Human
uuuuucuuucuuucuuucuuucuuucuuucuu

SEQ ID NO: 547790 - RNA, 32 nt, Human
uuuuucuuugagacugggucucgcuuuguugc

SEQ ID NO: 547791 - RNA, 32 nt, Human
uuuuucuuugagaugaagucucccucuuguua

SEQ ID NO: 547792 - RNA, 32 nt, Human
uuuuucuuugagaugcggucuugcucuguugc

SEQ ID NO: 547793 - RNA, 32 nt, Human
uuuuucuuuuaaauagaacuuguuuuuauaau

SEQ ID NO: 547794 - RNA, 32 nt, Human
uuuuucuuuucuuucuuucuccuuccuuccuu

SEQ ID NO: 547795 - RNA, 32 nt, Human
uuuuucuuuuggugcagaaccguugugcagug

SEQ ID NO: 547796 - RNA, 32 nt, Human
uuuuucuuuuguuagaggagagcuugauguga

SEQ ID NO: 547797 - RNA, 32 nt, Human
uuuuucuuuuuccucccuuagaaaguuucucu

SEQ ID NO: 547798 - RNA, 32 nt, Human
uuuuucuuuuuccugcuguauaacuccuugcc

SEQ ID NO: 547799 - RNA, 32 nt, Human
uuuuucuuuuucuccccuuccuccuuacccuc

SEQ ID NO: 547800 - RNA, 32 nt, Human
uuuuucuuuuucuuuuucuguuucucucccuu

SEQ ID NO: 547801 - RNA, 32 nt, Human
uuuuugaaaauuaauuaaagaugggaauaagu

SEQ ID NO: 547802 - RNA, 32 nt, Human
uuuuugaaacagaaucuugcucugucucccag

SEQ ID NO: 547803 - RNA, 24 nt, Human
uuuuugaaacagggucucacucua

SEQ ID NO: 547804 - RNA, 24 nt, Human
uuuuugaaacggagucucacucug

SEQ ID NO: 547805 - RNA, 24 nt, Human
uuuuugaaacgggagucucacucu

SEQ ID NO: 547806 - RNA, 32 nt, Human
uuuuugaaagaaugucuuggaaugcgcaaguc

SEQ ID NO: 547807 - RNA, 32 nt, Human
uuuuugaaagaguucuccucauaggaggauga

SEQ ID NO: 547808 - RNA, 32 nt, Human
uuuuugaaaguugccuuuucucuccacccuug

SEQ ID NO: 547809 - RNA, 24 nt, Human
uuuuugaaauaaggucucacucug

SEQ ID NO: 547810 - RNA, 32 nt, Human
uuuuugaaccaccacagacaucuccuuucccg

SEQ ID NO: 547811 - RNA, 32 nt, Human
uuuuugaacgugggaaucccuuuugcuucaug

SEQ ID NO: 547812 - RNA, 32 nt, Human
uuuuugaacuaaauaguggugauggcuacaca

SEQ ID NO: 547813 - RNA, 32 nt, Human
uuuuugaagagaaguuguggcuuauguggagu

SEQ ID NO: 547814 - RNA, 32 nt, Human
uuuuugaagcauuucauaagggccaaggaagu

SEQ ID NO: 547815 - RNA, 32 nt, Human
uuuuugaaggaguggauuuucuuuguugcagu

SEQ ID NO: 547816 - RNA, 32 nt, Human
uuuuugaaggcauaugguuggagagaaccauu

SEQ ID NO: 547817 - RNA, 32 nt, Human
uuuuugaauagagacuccauggaguuggucau

SEQ ID NO: 547818 - RNA, 32 nt, Human
uuuuugaauaguauguuacugcagcuuuggua

SEQ ID NO: 547819 - RNA, 32 nt, Human
uuuuugaauauuacucuugcucugguauuguu

SEQ ID NO: 547820 - RNA, 32 nt, Human
uuuuugaauauugcaggguucagucuagauug

SEQ ID NO: 547821 - RNA, 32 nt, Human
uuuuugaauguacugguaaugccuaauguggu

SEQ ID NO: 547822 - RNA, 23 nt, Human
uuuuugaauuucguauucuuuca

SEQ ID NO: 547823 - RNA, 32 nt, Human
uuuuugacaaaaauggcuccauuuuuccacag

SEQ ID NO: 547824 - RNA, 24 nt, Human
uuuuugacacggagucucacucug

SEQ ID NO: 547825 - RNA, 32 nt, Human
uuuuugacacuuccauuguuuaaaaauacaca

SEQ ID NO: 547826 - RNA, 32 nt, Human
uuuuugacagcaauggagaauggguuauauaa

SEQ ID NO: 547827 - RNA, 32 nt, Human
uuuuugacagcuuccugucaagcaaucaagaa

SEQ ID NO: 547828 - RNA, 22 nt, Human
uuuuugacagggucucacucug

SEQ ID NO: 547829 - RNA, 32 nt, Human
uuuuugacaucuuuauagcagugcuguuuccu

SEQ ID NO: 547830 - RNA, 32 nt, Human
uuuuugaccacugucuguucaccauguugcaa

SEQ ID NO: 547831 - RNA, 32 nt, Human
uuuuugaccuaagaucucagcaauuugaacac

SEQ ID NO: 547832 - RNA, 32 nt, Human
uuuuugacuguacauuacagugaaguguaauc

SEQ ID NO: 547833 - RNA, 32 nt, Human
uuuuugagaagagaugagguauauguuacaau

SEQ ID NO: 547834 - RNA, 22 nt, Human
uuuuugagaagaggucucacuc

SEQ ID NO: 547835 - RNA, 20 nt, Human
uuuuugagaagucucacucu

SEQ ID NO: 547836 - RNA, 24 nt, Human
uuuuugagacaaagucucacucug

SEQ ID NO: 547837 - RNA, 24 nt, Human
uuuuugagacaaggucucacucug

SEQ ID NO: 547838 - RNA, 24 nt, Human
uuuuugagacacagucucacucug

SEQ ID NO: 547839 - RNA, 23 nt, Human
uuuuugagacagaaucucacucu

SEQ ID NO: 547840 - RNA, 32 nt, Human
uuuuugagacagaguagcucucugccagccag

SEQ ID NO: 547841 - RNA, 24 nt, Human
uuuuugagacagagucucacccug

SEQ ID NO: 547842 - RNA, 32 nt, Human
uuuuugagacagagucucacccuguugcccag

SEQ ID NO: 547843 - RNA, 23 nt, Human
uuuuugagacagagucucacucu

SEQ ID NO: 547844 - RNA, 24 nt, Human
uuuuugagacagagucucacucua

SEQ ID NO: 547845 - RNA, 24 nt, Human
uuuuugagacagagucucacucug

SEQ ID NO: 547846 - RNA, 32 nt, Human
uuuuugagacagagucucacucuguugccagg

SEQ ID NO: 547847 - RNA, 32 nt, Human
uuuuugagacagagucucacucuguugcccag

SEQ ID NO: 547848 - RNA, 32 nt, Human
uuuuugagacagagucucacucuguugcccgg

SEQ ID NO: 547849 - RNA, 32 nt, Human
uuuuugagacagagucucacucuguugccuag

SEQ ID NO: 547850 - RNA, 32 nt, Human
uuuuugagacagagucucacucuuguugccca

SEQ ID NO: 547851 - RNA, 32 nt, Human
uuuuugagacagagucucacucuuucacccaa

SEQ ID NO: 547852 - RNA, 22 nt, Human
uuuuugagacagagucucauuc

SEQ ID NO: 547853 - RNA, 32 nt, Human
uuuuugagacagagucucccucugucaccagg

SEQ ID NO: 547854 - RNA, 32 nt, Human
uuuuugagacagagucucccucuguuguccaa

SEQ ID NO: 547855 - RNA, 22 nt, Human
uuuuugagacagagucucgcuc

SEQ ID NO: 547856 - RNA, 32 nt, Human
uuuuugagacagagucucgcuccauugcccag

SEQ ID NO: 547857 - RNA, 32 nt, Human
uuuuugagacagagucucgcucuauugcccag

SEQ ID NO: 547858 - RNA, 32 nt, Human
uuuuugagacagagucucgcucuguugccagg

SEQ ID NO: 547859 - RNA, 32 nt, Human
uuuuugagacagagucucgcucuguugcccag

SEQ ID NO: 547860 - RNA, 32 nt, Human
uuuuugagacagagucucgcucuguugccuag

SEQ ID NO: 547861 - RNA, 32 nt, Human
uuuuugagacagagucucgcucuuucacccag

SEQ ID NO: 547862 - RNA, 32 nt, Human
uuuuugagacagagucucucucuguugcccag

SEQ ID NO: 547863 - RNA, 24 nt, Human
uuuuugagacagggccucacucug

SEQ ID NO: 547864 - RNA, 23 nt, Human
uuuuugagacagggucucacucu

SEQ ID NO: 547865 - RNA, 24 nt, Human
uuuuugagacagggucucacucug

SEQ ID NO: 547866 - RNA, 22 nt, Human
uuuuugagacagucucacucug

SEQ ID NO: 547867 - RNA, 24 nt, Human
uuuuugagacagugccucacucug

SEQ ID NO: 547868 - RNA, 24 nt, Human
uuuuugagacauagucucacucug

SEQ ID NO: 547869 - RNA, 24 nt, Human
uuuuugagaccaagucucacucug

SEQ ID NO: 547870 - RNA, 24 nt, Human
uuuuugagaccgaaucucacucug

SEQ ID NO: 547871 - RNA, 32 nt, Human
uuuuugagaccuagggcuggagugcaguugag

SEQ ID NO: 547872 - RNA, 24 nt, Human
uuuuugagaccuagucucacucug

SEQ ID NO: 547873 - RNA, 23 nt, Human
uuuuugagacggagucccacucu

SEQ ID NO: 547874 - RNA, 24 nt, Human
uuuuugagacggagucucacucug

SEQ ID NO: 547875 - RNA, 25 nt, Human
uuuuugagacgggagucucgcucua

SEQ ID NO: 547876 - RNA, 24 nt, Human
uuuuugagacggggucucacucug

SEQ ID NO: 547877 - RNA, 32 nt, Human
uuuuugagacggggucucucucugucaucugg

SEQ ID NO: 547878 - RNA, 32 nt, Human
uuuuugagacgggguuucgcucuuguugucca

SEQ ID NO: 547879 - RNA, 32 nt, Human
uuuuugagacuaggucuugcucugucacccag

SEQ ID NO: 547880 - RNA, 27 nt, Human
uuuuugagacuccggagucucgcucua

SEQ ID NO: 547881 - RNA, 32 nt, Human
uuuuugagacugagucucacuccaucagccag

SEQ ID NO: 547882 - RNA, 24 nt, Human
uuuuugagacugagucucacucug

SEQ ID NO: 547883 - RNA, 24 nt, Human
uuuuugagacugagucucacuuua

SEQ ID NO: 547884 - RNA, 24 nt, Human
uuuuugagacugagucucauucua

SEQ ID NO: 547885 - RNA, 32 nt, Human
uuuuugagacugagucucucucuguugcccag

SEQ ID NO: 547886 - RNA, 32 nt, Human
uuuuugagagagagucuuacucugccgcccaa

SEQ ID NO: 547887 - RNA, 22 nt, Human
uuuuugagagggaguuucacuc

SEQ ID NO: 547888 - RNA, 32 nt, Human
uuuuugagagguugggcuggcagaucaugagg

SEQ ID NO: 547889 - RNA, 32 nt, Human
uuuuugagaguuuugcucugucacccaggcug

SEQ ID NO: 547890 - RNA, 24 nt, Human
uuuuugagauaaggucucacucua

SEQ ID NO: 547891 - RNA, 32 nt, Human
uuuuugagauagagucuuguucugcugcccaa

SEQ ID NO: 547892 - RNA, 32 nt, Human
uuuuugagauagggucuugcucucucacccag

SEQ ID NO: 547893 - RNA, 21 nt, Human
uuuuugagaugaagucucacu

SEQ ID NO: 547894 - RNA, 24 nt, Human
uuuuugagaugaagucucacucug

SEQ ID NO: 547895 - RNA, 24 nt, Human
uuuuugagauggaaucucacucug

SEQ ID NO: 547896 - RNA, 32 nt, Human
uuuuugagauggaaucucucucuguugcccag

SEQ ID NO: 547897 - RNA, 23 nt, Human
uuuuugagauggagucucacucu

SEQ ID NO: 547898 - RNA, 24 nt, Human
uuuuugagauggagucucacucug

SEQ ID NO: 547899 - RNA, 32 nt, Human
uuuuugagauggagucucgcuccaucaccagg

SEQ ID NO: 547900 - RNA, 24 nt, Human
uuuuugagauggagucucgcucua

SEQ ID NO: 547901 - RNA, 32 nt, Human
uuuuugagauggagucucucucugucacccaa

SEQ ID NO: 547902 - RNA, 32 nt, Human
uuuuugagauggagucucucucugucacccag

SEQ ID NO: 547903 - RNA, 32 nt, Human
uuuuugagauggagucucuugcucugucaucc

SEQ ID NO: 547904 - RNA, 32 nt, Human
uuuuugagauggaguuucacccuuguugccca

SEQ ID NO: 547905 - RNA, 32 nt, Human
uuuuugagauggggacucacucuguugcccag

SEQ ID NO: 547906 - RNA, 32 nt, Human
uuuuugagauggggucucgcuauguugaccag

SEQ ID NO: 547907 - RNA, 32 nt, Human
uuuuugagauggggucucgcucugucaccagg

SEQ ID NO: 547908 - RNA, 32 nt, Human
uuuuugagauggggucuuccucuguugcccag

SEQ ID NO: 547909 - RNA, 32 nt, Human
uuuuugagauggggucuugcuauguugcccag

SEQ ID NO: 547910 - RNA, 32 nt, Human
uuuuugagauggguucucacuauauuguccag

SEQ ID NO: 547911 - RNA, 24 nt, Human
uuuuugagauguagucucacccug

SEQ ID NO: 547912 - RNA, 32 nt, Human
uuuuugagauguagucuuacucugucacccag

SEQ ID NO: 547913 - RNA, 24 nt, Human
uuuuugagccagugucucacucug

SEQ ID NO: 547914 - RNA, 32 nt, Human
uuuuugagccugggcgacagagcgagacucca

SEQ ID NO: 547915 - RNA, 32 nt, Human
uuuuugagccugggcgacagagugagacuccg

SEQ ID NO: 547916 - RNA, 32 nt, Human
uuuuugaggagucgucuugcucuaucaccagg

SEQ ID NO: 547917 - RNA, 32 nt, Human
uuuuugaggaguuucgcucuuguuggcuaggc

SEQ ID NO: 547918 - RNA, 24 nt, Human
uuuuugaggcagagucucacucug

SEQ ID NO: 547919 - RNA, 23 nt, Human
uuuuugaggcgcgucucacccug

SEQ ID NO: 547920 - RNA, 32 nt, Human
uuuuugaggggaagcuggaggcuccccaagga

SEQ ID NO: 547921 - RNA, 32 nt, Human
uuuuugagguggggacacaggagguccagugg

SEQ ID NO: 547922 - RNA, 32 nt, Human
uuuuugaguacauacuauguguuucagaaaua

SEQ ID NO: 547923 - RNA, 32 nt, Human
uuuuugagucagagucucgcucuguugcccag

SEQ ID NO: 547924 - RNA, 32 nt, Human
uuuuugaguguuuucacccugaaaagauuuug

SEQ ID NO: 547925 - RNA, 24 nt, Human
uuuuugauacagagucucacucug

SEQ ID NO: 547926 - RNA, 32 nt, Human
uuuuugauacuuuuuagagcaggauuuuucug

SEQ ID NO: 547927 - RNA, 26 nt, Human
uuuuugauauacuggcuugggaccua

SEQ ID NO: 547928 - RNA, 32 nt, Human
uuuuugauauccauguagggguauuucccaua

SEQ ID NO: 547929 - RNA, 32 nt, Human
uuuuugaugaaaccaggauggcgucgugcggg

SEQ ID NO: 547930 - RNA, 32 nt, Human
uuuuugaugcugcuguguacagucuucauuau

SEQ ID NO: 547931 - RNA, 22 nt, Human
uuuuugauggagucucacucug

SEQ ID NO: 547932 - RNA, 25 nt, Human
uuuuugauguuauuguugggacuua

SEQ ID NO: 547933 - RNA, 32 nt, Human
uuuuugauuaaagcucuucaauccagaugcaa

SEQ ID NO: 547934 - RNA, 32 nt, Human
uuuuugauuauaguaacugagauggaauuuug

SEQ ID NO: 547935 - RNA, 28 nt, Human
uuuuugauugucaguccuauggggcuua

SEQ ID NO: 547936 - RNA, 32 nt, Human
uuuuugauuucuuccagaaggcaaaaagacau

SEQ ID NO: 547937 - RNA, 32 nt, Human
uuuuugcaagagccacuuuuuauuuacuuucu

SEQ ID NO: 547938 - RNA, 32 nt, Human
uuuuugcacaucuggcugaacugggagucagg

SEQ ID NO: 547939 - RNA, 32 nt, Human
uuuuugcaccucuugugcauucugcaagaaga

SEQ ID NO: 547940 - RNA, 32 nt, Human
uuuuugcacugauuuuucuauaccuuaggugg

SEQ ID NO: 547941 - RNA, 32 nt, Human
uuuuugcagauucuuggcuggguuuaguguac

SEQ ID NO: 547942 - RNA, 32 nt, Human
uuuuugcagcccagagcagaacagggaaaagg

SEQ ID NO: 547943 - RNA, 22 nt, Human
uuuuugcauuuguuuauugaau

SEQ ID NO: 547944 - RNA, 32 nt, Human
uuuuugccaaacuguacuuggccacauucagu

SEQ ID NO: 547945 - RNA, 32 nt, Human
uuuuugccaguaaaccaaaaagcagauccuug

SEQ ID NO: 547946 - RNA, 32 nt, Human
uuuuugccauggcuaaucccugcauuuccauu

SEQ ID NO: 547947 - RNA, 22 nt, Human
uuuuugcccaggccggagugca

SEQ ID NO: 547948 - RNA, 32 nt, Human
uuuuugcccaggccggagugcaauggcacgau

SEQ ID NO: 547949 - RNA, 24 nt, Human
uuuuugcccaggcuggagugcagu

SEQ ID NO: 547950 - RNA, 32 nt, Human
uuuuugcccaggcuggagugcaguggcgccau

SEQ ID NO: 547951 - RNA, 32 nt, Human
uuuuugcccaggcuggagugcaguggugcgau

SEQ ID NO: 547952 - RNA, 32 nt, Human
uuuuugccccugcuuuugcuuuggauuauacc

SEQ ID NO: 547953 - RNA, 32 nt, Human
uuuuugccccuucaacuguuuucaucugcccu

SEQ ID NO: 547954 - RNA, 32 nt, Human
uuuuugcccuuccuuucuuuaaagcuauucuc

SEQ ID NO: 547955 - RNA, 32 nt, Human
uuuuugccuaggcuggagugcagugguacaau

SEQ ID NO: 547956 - RNA, 32 nt, Human
uuuuugccucacuuaauuccagccuuuuguuu

SEQ ID NO: 547957 - RNA, 32 nt, Human
uuuuugccuccaccaucauguuuuccaucacu

SEQ ID NO: 547958 - RNA, 32 nt, Human
uuuuugccuccaccuuuuagcccacaucauuu

SEQ ID NO: 547959 - RNA, 32 nt, Human
uuuuugccucuuuagauuacauagaagcauug

SEQ ID NO: 547960 - RNA, 32 nt, Human
uuuuugcuauaccauuuuauuuccgaaguuga

SEQ ID NO: 547961 - RNA, 32 nt, Human
uuuuugcucugccccugaccccuugucccucu

SEQ ID NO: 547962 - RNA, 32 nt, Human
uuuuugcugcuggccacccaugccucugauga

SEQ ID NO: 547963 - RNA, 32 nt, Human
uuuuugcugcuuggagugaucacaggccugug

SEQ ID NO: 547964 - RNA, 32 nt, Human
uuuuugcuggugguaaugaugaguuuugucac

SEQ ID NO: 547965 - RNA, 32 nt, Human
uuuuugcuuaacuuccauguucugggugaugg

SEQ ID NO: 547966 - RNA, 32 nt, Human
uuuuugcuucaguuguaaagaagagggaauac

SEQ ID NO: 547967 - RNA, 32 nt, Human
uuuuugcuugcuuaagaaugauuuggacuuuc

SEQ ID NO: 547968 - RNA, 32 nt, Human
uuuuugcuugucugaugacugauggcuccacc

SEQ ID NO: 547969 - RNA, 32 nt, Human
uuuuugcuuugacugcagucagcuguccuucc

SEQ ID NO: 547970 - RNA, 32 nt, Human
uuuuuggaaugcgagcucccaccagaagaagg

SEQ ID NO: 547971 - RNA, 22 nt, Human
uuuuuggacacacccaggaagg

SEQ ID NO: 547972 - RNA, 32 nt, Human
uuuuuggagaaaaggaacagggcaguggaaug

SEQ ID NO: 547973 - RNA, 32 nt, Human
uuuuuggagacagggucucacucugucacaca

SEQ ID NO: 547974 - RNA, 32 nt, Human
uuuuuggagacagggucucacuguguugccca

SEQ ID NO: 547975 - RNA, 32 nt, Human
uuuuuggagacagggucucgcucuguugccca

SEQ ID NO: 547976 - RNA, 32 nt, Human
uuuuuggagacagggucucgcugcgguggcac

SEQ ID NO: 547977 - RNA, 32 nt, Human
uuuuuggagacagggucucucucuguggccca

SEQ ID NO: 547978 - RNA, 32 nt, Human
uuuuuggagacagggucuugcucugucgccca

SEQ ID NO: 547979 - RNA, 32 nt, Human
uuuuuggagauggacucucauucugucacccg

SEQ ID NO: 547980 - RNA, 32 nt, Human
uuuuuggagauggagucucgcucugucgccca

SEQ ID NO: 547981 - RNA, 32 nt, Human
uuuuuggagaugguucugacucugucacccag

SEQ ID NO: 547982 - RNA, 32 nt, Human
uuuuuggagcccugucucacuugauugacagc

SEQ ID NO: 547983 - RNA, 32 nt, Human
uuuuuggagcuuccauccugguucuuccaaag

SEQ ID NO: 547984 - RNA, 32 nt, Human
uuuuuggaucagcucagacauauuucaguaua

SEQ ID NO: 547985 - RNA, 32 nt, Human
uuuuuggaugaagaaaaagccaguugguaagc

SEQ ID NO: 547986 - RNA, 32 nt, Human
uuuuuggaugcugaugauagacuugcaucuca

SEQ ID NO: 547987 - RNA, 32 nt, Human
uuuuuggcaaaaauuucacaagacuuauuuua

SEQ ID NO: 547988 - RNA, 32 nt, Human
uuuuuggcaaagcacaucaauguuagacuagu

SEQ ID NO: 547989 - RNA, 32 nt, Human
uuuuuggcacauacuagaaaggcagugccuca

SEQ ID NO: 547990 - RNA, 32 nt, Human
uuuuuggcaccauaguagaacaugguugcuuu

SEQ ID NO: 547991 - RNA, 18 nt, Human
uuuuuggcccucccucag

SEQ ID NO: 547992 - RNA, 32 nt, Human
uuuuuggcgagacagggucucacucuguuacc

SEQ ID NO: 547993 - RNA, 32 nt, Human
uuuuuggcugccucugucggucuguucaguua

SEQ ID NO: 547994 - RNA, 32 nt, Human
uuuuuggcugugagacuagcacuaaggauucu

SEQ ID NO: 547995 - RNA, 32 nt, Human
uuuuuggcuguggcuggaauaaaucauuuauu

SEQ ID NO: 547996 - RNA, 32 nt, Human
uuuuugggaaaaggaaaaacgaguaaaaauaa

SEQ ID NO: 547997 - RNA, 32 nt, Human
uuuuugggaaaaucauauauccuaucuucuca

SEQ ID NO: 547998 - RNA, 32 nt, Human
uuuuugggaagguagaagcauuuggcacagaa

SEQ ID NO: 547999 - RNA, 22 nt, Human
uuuuugggacagagucucacuc

SEQ ID NO: 548000 - RNA, 22 nt, Human
uuuuugggacggagucucacuc

SEQ ID NO: 548001 - RNA, 32 nt, Human
uuuuugggaggcaccaggcggggaggaguugg

SEQ ID NO: 548002 - RNA, 32 nt, Human
uuuuugggaguuauucccuaaauaacugcauu

SEQ ID NO: 548003 - RNA, 32 nt, Human
uuuuugggcugauuccaaggggcuuaugugug

SEQ ID NO: 548004 - RNA, 32 nt, Human
uuuuuggggaaaggaaacuaguaguguuuccu

SEQ ID NO: 548005 - RNA, 32 nt, Human
uuuuuggggauggagucucccucuguugccca

SEQ ID NO: 548006 - RNA, 32 nt, Human
uuuuuggggauguggagguaguuggguagaaa

SEQ ID NO: 548007 - RNA, 32 nt, Human
uuuuuggggcagagaggcacucaggcugguuu

SEQ ID NO: 548008 - RNA, 22 nt, Human
uuuuugguaacguaacugucaa

SEQ ID NO: 548009 - RNA, 32 nt, Human
uuuuugguacaauuacuucaucuggaaugucu

SEQ ID NO: 548010 - RNA, 24 nt, Human
uuuuugguauuuuuuguauuguaa

SEQ ID NO: 548011 - RNA, 32 nt, Human
uuuuuggucagcaugguugaugaacuaaugau

SEQ ID NO: 548012 - RNA, 32 nt, Human
uuuuuggugagguuggaagauggauggaagcc

SEQ ID NO: 548013 - RNA, 32 nt, Human
uuuuuggugcaguuucagcucacugcaaccuc

SEQ ID NO: 548014 - RNA, 18 nt, Human
uuuuuggugcucccucag

SEQ ID NO: 548015 - RNA, 32 nt, Human
uuuuuggugcugcugguuucuccagaccucgc

SEQ ID NO: 548016 - RNA, 23 nt, Human
uuuuugguggcucucaacuggaa

SEQ ID NO: 548017 - RNA, 32 nt, Human
uuuuuggugugaguuuucacauacuuuauuuc

SEQ ID NO: 548018 - RNA, 32 nt, Human
uuuuugguuccacaccugucuucucaggcuug

SEQ ID NO: 548019 - RNA, 32 nt, Human
uuuuugguugcaaaacagagacaugguucuau

SEQ ID NO: 548020 - RNA, 17 nt, Human
uuuuugguuuccuucag

SEQ ID NO: 548021 - RNA, 16 nt, Human
uuuuugguuucuucaa

SEQ ID NO: 548022 - RNA, 32 nt, Human
uuuuugguuugaagacuuugucuaagccucau

SEQ ID NO: 548023 - RNA, 32 nt, Human
uuuuugguuugcgucaucaucaggcccgggcu

SEQ ID NO: 548024 - RNA, 32 nt, Human
uuuuugguuuguuuguuuguuuucccuucccc

SEQ ID NO: 548025 - RNA, 32 nt, Human
uuuuugguuuuuaagaauuucuugauacucuu

SEQ ID NO: 548026 - RNA, 32 nt, Human
uuuuuguaacuugccauccgcacagaaaauac

SEQ ID NO: 548027 - RNA, 32 nt, Human
uuuuuguaaggaagaucauaaaugcuaaaaau

SEQ ID NO: 548028 - RNA, 32 nt, Human
uuuuuguaagguuuuuguguuuuccuuucauu

SEQ ID NO: 548029 - RNA, 32 nt, Human
uuuuuguaauguuggcauacuuggggaauuua

SEQ ID NO: 548030 - RNA, 32 nt, Human
uuuuuguacaguauuuucuccuucguuguauu

SEQ ID NO: 548031 - RNA, 32 nt, Human
uuuuuguaccagagucccagacuaacuguugg

SEQ ID NO: 548032 - RNA, 32 nt, Human
uuuuuguagacagggucucacuguguugccca

SEQ ID NO: 548033 - RNA, 32 nt, Human
uuuuuguagacagggucucccuauguugccca

SEQ ID NO: 548034 - RNA, 32 nt, Human
uuuuuguagagaagagauuuggccauguugcc

SEQ ID NO: 548035 - RNA, 32 nt, Human
uuuuuguagcuacugguguacuaugacaguua

SEQ ID NO: 548036 - RNA, 32 nt, Human
uuuuuguaguuguggcaucuuguugacaucga

SEQ ID NO: 548037 - RNA, 32 nt, Human
uuuuuguauaacugcuuccugccuccuuccaa

SEQ ID NO: 548038 - RNA, 32 nt, Human
uuuuuguauacaaauaaaauuugaacugaacc

SEQ ID NO: 548039 - RNA, 32 nt, Human
uuuuuguauuuauuuucuacuguguaaaugua

SEQ ID NO: 548040 - RNA, 32 nt, Human
uuuuuguauuuuuaauaaagaugggguuucac

SEQ ID NO: 548041 - RNA, 32 nt, Human
uuuuuguauuuuuaauagagacaggguuucac

SEQ ID NO: 548042 - RNA, 32 nt, Human
uuuuuguauuuuuaauagagacgggguuucac

SEQ ID NO: 548043 - RNA, 32 nt, Human
uuuuuguauuuuuaauagagacgggguuucgc

SEQ ID NO: 548044 - RNA, 32 nt, Human
uuuuuguauuuuuaauagagaugggguuucac

SEQ ID NO: 548045 - RNA, 32 nt, Human
uuuuuguauuuuuaauagagaugggguuuugc

SEQ ID NO: 548046 - RNA, 32 nt, Human
uuuuuguauuuuuacuagagacaggguuucac

SEQ ID NO: 548047 - RNA, 32 nt, Human
uuuuuguauuuuuacuagagacgggguuucag

SEQ ID NO: 548048 - RNA, 32 nt, Human
uuuuuguauuuuuacuggagacaggguuucac

SEQ ID NO: 548049 - RNA, 32 nt, Human
uuuuuguauuuuuagaagagaugggguuucuc

SEQ ID NO: 548050 - RNA, 32 nt, Human
uuuuuguauuuuuagcagagaugggguuucac

SEQ ID NO: 548051 - RNA, 32 nt, Human
uuuuuguauuuuuagcagagaugggguuuuac

SEQ ID NO: 548052 - RNA, 32 nt, Human
uuuuuguauuuuuaggagagaugggguuucgc

SEQ ID NO: 548053 - RNA, 32 nt, Human
uuuuuguauuuuuaguagagacaggguucuua

SEQ ID NO: 548054 - RNA, 32 nt, Human
uuuuuguauuuuuaguagagacaggguuggcc

SEQ ID NO: 548055 - RNA, 32 nt, Human
uuuuuguauuuuuaguagagacaggguuucac

SEQ ID NO: 548056 - RNA, 32 nt, Human
uuuuuguauuuuuaguagagacaggguuucau

SEQ ID NO: 548057 - RNA, 32 nt, Human
uuuuuguauuuuuaguagagacaggguuucca

SEQ ID NO: 548058 - RNA, 32 nt, Human
uuuuuguauuuuuaguagagacaggguuucgc

SEQ ID NO: 548059 - RNA, 32 nt, Human
uuuuuguauuuuuaguagagacaggguuuuac

SEQ ID NO: 548060 - RNA, 32 nt, Human
uuuuuguauuuuuaguagagacaggguuuugc

SEQ ID NO: 548061 - RNA, 32 nt, Human
uuuuuguauuuuuaguagagacgaggguucac

SEQ ID NO: 548062 - RNA, 32 nt, Human
uuuuuguauuuuuaguagagacgggguaucac

SEQ ID NO: 548063 - RNA, 32 nt, Human
uuuuuguauuuuuaguagagacgguguuucac

SEQ ID NO: 548064 - RNA, 32 nt, Human
uuuuuguauuuuuaguagagacgguguuucag

SEQ ID NO: 548065 - RNA, 32 nt, Human
uuuuuguauuuuuaguagagauagggucucac

SEQ ID NO: 548066 - RNA, 32 nt, Human
uuuuuguauuuuuaguagagauaggguuucac

SEQ ID NO: 548067 - RNA, 32 nt, Human
uuuuuguauuuuuaguagagauggggcuucac

SEQ ID NO: 548068 - RNA, 32 nt, Human
uuuuuguauuuuuaguagagauggggguuuca

SEQ ID NO: 548069 - RNA, 32 nt, Human
uuuuuguauuuuuaguagagauggggguuuuc

SEQ ID NO: 548070 - RNA, 32 nt, Human
uuuuuguauuuuuaguagagauggggucucac

SEQ ID NO: 548071 - RNA, 32 nt, Human
uuuuuguauuuuuaguagagaugggguuccac

SEQ ID NO: 548072 - RNA, 32 nt, Human
uuuuuguauuuuuaguagagaugggguuucac

SEQ ID NO: 548073 - RNA, 32 nt, Human
uuuuuguauuuuuaguagagaugggguuucau

SEQ ID NO: 548074 - RNA, 32 nt, Human
uuuuuguauuuuuaguagagaugggguuuccc

SEQ ID NO: 548075 - RNA, 32 nt, Human
uuuuuguauuuuuaguagagaugggguuucgc

SEQ ID NO: 548076 - RNA, 32 nt, Human
uuuuuguauuuuuaguagagaugggguuucuc

SEQ ID NO: 548077 - RNA, 32 nt, Human
uuuuuguauuuuuaguagagaugggguuugac

SEQ ID NO: 548078 - RNA, 32 nt, Human
uuuuuguauuuuuaguagagaugggguuugcc

SEQ ID NO: 548079 - RNA, 32 nt, Human
uuuuuguauuuuuaguagagaugggguuuggc

SEQ ID NO: 548080 - RNA, 32 nt, Human
uuuuuguauuuuuaguagagaugggguuuuac

SEQ ID NO: 548081 - RNA, 32 nt, Human
uuuuuguauuuuuaguagagaugggguuuugc

SEQ ID NO: 548082 - RNA, 32 nt, Human
uuuuuguauuuuuaguagagauuggguuucac

SEQ ID NO: 548083 - RNA, 32 nt, Human
uuuuuguauuuuuaguagaggaugggguuuca

SEQ ID NO: 548084 - RNA, 32 nt, Human
uuuuuguauuuuuaguagaggugggguuucac

SEQ ID NO: 548085 - RNA, 32 nt, Human
uuuuuguauuuuuaguagaggugggguuucau

SEQ ID NO: 548086 - RNA, 32 nt, Human
uuuuuguauuuuuaguagggaugggguuucac

SEQ ID NO: 548087 - RNA, 32 nt, Human
uuuuuguauuuuuaguggagauaggguuucac

SEQ ID NO: 548088 - RNA, 32 nt, Human
uuuuuguauuuuuaguggagaugggguuucac

SEQ ID NO: 548089 - RNA, 32 nt, Human
uuuuuguauuuuuaguggagaugggguuuuac

SEQ ID NO: 548090 - RNA, 32 nt, Human
uuuuuguauuuuuaguggggaugggguuucac

SEQ ID NO: 548091 - RNA, 32 nt, Human
uuuuuguauuuuuaguugagaugggguuuuuc

SEQ ID NO: 548092 - RNA, 32 nt, Human
uuuuuguauuuuuauagagacaggguuucacc

SEQ ID NO: 548093 - RNA, 32 nt, Human
uuuuuguauuuuuauagagauaggguuucacc

SEQ ID NO: 548094 - RNA, 32 nt, Human
uuuuuguauuuuuauuagagacgggguuucac

SEQ ID NO: 548095 - RNA, 32 nt, Human
uuuuuguauuuuuauuagagaugggguuucac

SEQ ID NO: 548096 - RNA, 32 nt, Human
uuuuuguauuuuuauuggagacaggguuucac

SEQ ID NO: 548097 - RNA, 32 nt, Human
uuuuugucaacacucuguaucuaguuaaucug

SEQ ID NO: 548098 - RNA, 32 nt, Human
uuuuugucagcuuuguccaagaucagaugauu

SEQ ID NO: 548099 - RNA, 32 nt, Human
uuuuugucauggugaccagcaguguucccaau

SEQ ID NO: 548100 - RNA, 32 nt, Human
uuuuugucauuuuaaugcuuucuugaauaauu

SEQ ID NO: 548101 - RNA, 32 nt, Human
uuuuuguccaccacccugcucuuuuuaauaau

SEQ ID NO: 548102 - RNA, 32 nt, Human
uuuuuguccagccugccgcuccuggacugccc

SEQ ID NO: 548103 - RNA, 32 nt, Human
uuuuuguccaguuucuuugggggaaggaagac

SEQ ID NO: 548104 - RNA, 32 nt, Human
uuuuuguccugaugucuaaauugcagugauaa

SEQ ID NO: 548105 - RNA, 32 nt, Human
uuuuuguccuuaaucagugugauaugaaaagc

SEQ ID NO: 548106 - RNA, 32 nt, Human
uuuuugucuauuuucuauuuuaguuguggcuu

SEQ ID NO: 548107 - RNA, 32 nt, Human
uuuuugucucuucuuuuugccuaaagccaguc

SEQ ID NO: 548108 - RNA, 32 nt, Human
uuuuugucugucuuugugaggcugcuuugcua

SEQ ID NO: 548109 - RNA, 32 nt, Human
uuuuugucuuccuuuuggcuuuauuuuuaaac

SEQ ID NO: 548110 - RNA, 32 nt, Human
uuuuugucuuguaggauuugcucuuuauuugg

SEQ ID NO: 548111 - RNA, 32 nt, Human
uuuuugucuuuaaugucaggcuuuagauuaga

SEQ ID NO: 548112 - RNA, 32 nt, Human
uuuuugucuuuugguuucuuccuuucuccugg

SEQ ID NO: 548113 - RNA, 32 nt, Human
uuuuugucuuuugguuucuuccuuucuucugg

SEQ ID NO: 548114 - RNA, 32 nt, Human
uuuuugugaagcacuggcauaguugagcaagu

SEQ ID NO: 548115 - RNA, 32 nt, Human
uuuuugugagugagacugagggaucguagauu

SEQ ID NO: 548116 - RNA, 32 nt, Human
uuuuugugcacugugauccuggggaaggguag

SEQ ID NO: 548117 - RNA, 32 nt, Human
uuuuuguggcaggcaucugugggaucuguaau

SEQ ID NO: 548118 - RNA, 32 nt, Human
uuuuuguggccaaauauccuacugugaucacu

SEQ ID NO: 548119 - RNA, 32 nt, Human
uuuuuguggcugcuuuuucuacacauccagau

SEQ ID NO: 548120 - RNA, 32 nt, Human
uuuuuguguggauaugaaacuuaggaaggauc

SEQ ID NO: 548121 - RNA, 32 nt, Human
uuuuuguguuguuccguaugcuaacaugugca

SEQ ID NO: 548122 - RNA, 32 nt, Human
uuuuuguguuuuaguagagauaggguuucacc

SEQ ID NO: 548123 - RNA, 32 nt, Human
uuuuuguuaaaauguuaacuggcaguaagucu

SEQ ID NO: 548124 - RNA, 32 nt, Human
uuuuuguuacaaaaggacagacuuggcaaaca

SEQ ID NO: 548125 - RNA, 32 nt, Human
uuuuuguuacaaaaggacagacuuggcaagca

SEQ ID NO: 548126 - RNA, 32 nt, Human
uuuuuguuacugacaguuaacaguggugugac

SEQ ID NO: 548127 - RNA, 32 nt, Human
uuuuuguuauucuucccuccccuccacugcau

SEQ ID NO: 548128 - RNA, 32 nt, Human
uuuuuguucacugcaaccucugccuuccaaga

SEQ ID NO: 548129 - RNA, 32 nt, Human
uuuuuguuccaaucuucugugaguuccagcua

SEQ ID NO: 548130 - RNA, 32 nt, Human
uuuuuguuccuuuuuauuuaucugugggcuuu

SEQ ID NO: 548131 - RNA, 32 nt, Human
uuuuuguucuaauauuugauuuaugagaaaug

SEQ ID NO: 548132 - RNA, 32 nt, Human
uuuuuguucucuucccugaagugcuuuacagu

SEQ ID NO: 548133 - RNA, 32 nt, Human
uuuuuguucugccucucaaacuccugaccuca

SEQ ID NO: 548134 - RNA, 32 nt, Human
uuuuuguucuucucacacaauuacuuaagaaa

SEQ ID NO: 548135 - RNA, 32 nt, Human
uuuuuguucuuguuguucucguuguuguuuua

SEQ ID NO: 548136 - RNA, 32 nt, Human
uuuuuguucuuuauucauuugaacacguuuuu

SEQ ID NO: 548137 - RNA, 32 nt, Human
uuuuuguugagaauccacuggcuaucucauaa

SEQ ID NO: 548138 - RNA, 32 nt, Human
uuuuuguugcagaucucgguaccagguuugac

SEQ ID NO: 548139 - RNA, 32 nt, Human
uuuuuguugcuuggcuuuugaaugaguguaaa

SEQ ID NO: 548140 - RNA, 32 nt, Human
uuuuuguugguugccacagcuuggggaaaaau

SEQ ID NO: 548141 - RNA, 32 nt, Human
uuuuuguuucauuuucuucugucucaccucgu

SEQ ID NO: 548142 - RNA, 32 nt, Human
uuuuuguuugagacagagucucgcucugucgu

SEQ ID NO: 548143 - RNA, 32 nt, Human
uuuuuguuugagauggagucucacucugucac

SEQ ID NO: 548144 - RNA, 32 nt, Human
uuuuuguuugugaauaguacuugcaaaacuug

SEQ ID NO: 548145 - RNA, 32 nt, Human
uuuuuguuuguuuuccuuuuccauuuucaaaa

SEQ ID NO: 548146 - RNA, 32 nt, Human
uuuuuguuuguuuuccuuuuugcccaauagag

SEQ ID NO: 548147 - RNA, 32 nt, Human
uuuuuguuuuagcuauccagguugugacuggu

SEQ ID NO: 548148 - RNA, 32 nt, Human
uuuuuguuuucugcuuuuaugacuguauuuau

SEQ ID NO: 548149 - RNA, 32 nt, Human
uuuuuguuuugacuuguauaauuaaggguuug

SEQ ID NO: 548150 - RNA, 32 nt, Human
uuuuuguuuuugcccccaguucuguccacacc

SEQ ID NO: 548151 - RNA, 22 nt, Human
uuuuuuagguggggguggcagg

SEQ ID NO: 548152 - RNA, 21 nt, Human
uuuuuucaugggggaggcggg

SEQ ID NO: 548153 - RNA, 24 nt, Human
uuuuuuccagauuugggguauagg

SEQ ID NO: 548154 - RNA, 18 nt, Human
uuuuuuccagcauacagu

SEQ ID NO: 548155 - RNA, 23 nt, Human
uuuuuuccuggcuggggggcggg

SEQ ID NO: 548156 - RNA, 22 nt, Human
uuuuuucuaugguguaugacag

SEQ ID NO: 548157 - DNA, 15 bp, Human
tttaaccgcattctc

SEQ ID NO: 548158 - DNA, 20 bp, Human
tactaatacgactcactaaa

SEQ ID NO: 548159 - DNA, 30 bp, Human
gactagctggaattcaaggatgcggttaaa

SEQ ID NO: 548160 - DNA, 30 bp, Human
cagccaacgctgcagatacgactcactaaa

SEQ ID NO: 548161 - DNA, 50 bp, Human
  misc_feature (50)..(50): n is a, c, g or t
  misc_feature (33)..(33): n=i
  misc_feature (37)..(38): n=i
  misc_feature (42)..(43): n=i
  misc_feature (47)..(48): n=i
aattaaccctcactaaaggctgcaggtgcaggngggnngggnngggnngn

SEQ ID NO: 548162 - DNA, 20 bp, Human
ggaattcaaggatgcggtta

SEQ ID NO: 548163 - DNA, 10 bp, Human
  misc_feature (3)..(4): n is a, c, g or t
  misc_feature (8)..(9): n is a, c, g or t
ggnngggnng

SEQ ID NO: 548164 - DNA, 12 bp, Human
tttaaccgcatc

SEQ ID NO: 548165 - DNA, 12 bp, Human
cgactcactaaa

SEQ ID NO: 548166 - DNA, 40 bp, Human
taatacgactcactataggcccttattagaggattctgct

SEQ ID NO: 548167 - DNA, 41 bp, Human
aattaaccctcactaaaggtttttttttcctgagacagagt

SEQ ID NO: 548168 - DNA, 42 bp, Human
taatacgactcactatagggtgaggtagtaagttgtattgtt

SEQ ID NO: 548169 - DNA, 41 bp, Human
aattaaccctcactaaagggaaagtagtaagttgtatagtt

SEQ ID NO: 548170 - DNA, 20 bp, Human
gaggcaggagaattgcttga

SEQ ID NO: 548171 - DNA, 39 bp, Human
aattaaccctcactaaaggcctgagacagagtcttgctc

SEQ ID NO: 548172 - DNA, 87 bp, Human
cccgtgaggaacagtggcgggattgtcccagggccccttccagcagggggacctcctgacttgagagtccccaaagccttcccaggg

SEQ ID NO: 548173 - DNA, 90 bp, Human
ctccacctgtttgctagcataacaggcgtgaaggcggcagtgtcgccggcgtccttccgcggaagcccagtgtgtgcagacagcacgggg

SEQ ID NO: 548174 - DNA, 60 bp, Human
tgggttcctggcatgctgatttgtgacttaagattaaaatcacattgccagggattacca

SEQ ID NO: 548175 - DNA, 132 bp, Human
ggtcgcgctcactgcagattggagaacaggtgcatctcgtagctcttctttggaaacaaaagaagccaccagctgaggaagatgctcaccggtcaccggtcaccgtccctttatttatgcccagcgatgacc

SEQ ID NO: 548176 - DNA, 87 bp, Human
ctctaacaaggtgcagagcttagctgattggtgaacagtgattggtttccgctttgttcacagtggctaagttctgcacctgaagag

SEQ ID NO: 548177 - DNA, 81 bp, Human
tggggacagttaagttggagccgctggggcagaggccgttgctgacgggccggccgctgctgcacagtcagcttgggtgcg

SEQ ID NO: 548178 - DNA, 82 bp, Human
ggctgtgagcggggcggggcggggctttcggaggagctcctgttgttctgggcgcggtgaactctctcttgtatttgcagtc

SEQ ID NO: 548179 - DNA, 68 bp, Human
ctccggtgcctactgagctgatatcagttctcattttacacactggctcagttcagcaggaacaggag

SEQ ID NO: 548180 - DNA, 86 bp, Human
tagcagctattgtgtacgcaaagcctgagtacagcctgctggtgtcatggccacgtgtgagcaggccagcgtcacacggctcgctg

SEQ ID NO: 548181 - DNA, 705 bp, Human
cccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcggtggttcatgcctgtaatcccagcatttttgggaggccgaggcgggtggatcacctgaggtcaggagttcgagaccaacctggccaacacggcgaaaccccgcctctactcaaatacaaaaattagccaggcttggtgacactcgcctgtggtcccagctactcaggaggctgaggcaggagaattgcttgaacccaggaagtggaggcttcagtgagctgagaacacgccactgcactccagtcctgggcaacagagcaagactctgtctcaggaaaaaaaaag

SEQ ID NO: 548182 - DNA, 80 bp, Human
gtgaggtagtaagttgtattgttgtggggtagggatattaggccccaattagaagataactatacaacttactactttcc

SEQ ID NO: 548183 - DNA, 22 bp, Human
tgaggtagtaagttgtattgtt

SEQ ID NO: 548184 - DNA, 100 bp, Human
gaggcaggagaattgcttgaacccaggaagtggaggcttcagtgagctgagaacacgccactgcactccagtcctgggcaacagagcaagactctgtctc

SEQ ID NO: 548185 - DNA, 24 bp, Human
aattgcttgaacccaggaagtgga
